(12) United States Patent
Seibert et al.

(10) Patent No.: US 10,155,818 B2
(45) Date of Patent: Dec. 18, 2018

(54) ANTI-GITR ANTIBODIES AND METHODS OF USE THEREOF

(71) Applicants: Agenus Inc., Lexington, MA (US); Memorial Sloan-Kettering Cancer Center, New York, NY (US); Ludwig Institute for Cancer Research Ltd., Zurich (CH)

(72) Inventors: Volker Seibert, Lörrach (DE); Olivier Léger, Saint-Sixt (FR); Marc Van Dijk, Bilthoven (NL); Taha Merghoub, Jersey City, NJ (US); David Schaer, Mamaroneck, NY (US); Gerd Ritter, New York, NY (US); Takemasa Tsuji, Williamsville, NY (US)

(73) Assignees: Agenus Inc., Lexington, MA (US); Memorial Sloan-Kettering Cancer Center, New York, NY (US); Ludwig Institute for Cancer Research Ltd., Zurich (CH)

( * ) Notice: Subject to any disclaimer, the term of this patent is extended or adjusted under 35 U.S.C. 154(b) by 133 days.

(21) Appl. No.: 14/724,452

(22) Filed: May 28, 2015

(65) Prior Publication Data
US 2015/0368349 A1 Dec. 24, 2015

Related U.S. Application Data

(60) Provisional application No. 62/004,071, filed on May 28, 2014, provisional application No. 62/161,250, filed on May 13, 2015.

(51) Int. Cl.
| | |
|---|---|
| *C07K 16/28* | (2006.01) |
| *A61K 35/17* | (2015.01) |
| *G01N 33/50* | (2006.01) |
| *A61K 39/00* | (2006.01) |

(52) U.S. Cl.
CPC .......... *C07K 16/2878* (2013.01); *A61K 35/17* (2013.01); *C07K 16/2809* (2013.01); *G01N 33/502* (2013.01); *A61K 2039/507* (2013.01); *C07K 2317/24* (2013.01); *C07K 2317/34* (2013.01); *C07K 2317/56* (2013.01); *C07K 2317/565* (2013.01); *C07K 2317/75* (2013.01); *C07K 2317/76* (2013.01); *C07K 2317/92* (2013.01); *G01N 2333/70578* (2013.01)

(58) Field of Classification Search
CPC ............ C07K 16/2878; C07K 2317/24; C07K 2317/34; C07K 2317/76
See application file for complete search history.

(56) References Cited

U.S. PATENT DOCUMENTS

| | | | |
|---|---|---|---|
| 5,585,097 A | 12/1996 | Bolt et al. | |
| 5,624,821 A | 4/1997 | Winter et al. | |
| 5,648,260 A | 7/1997 | Winter et al. | |
| 5,677,425 A | 10/1997 | Bodmer et al. | |
| 5,693,780 A | 12/1997 | Newman et al. | |
| 5,869,046 A | 2/1999 | Presta et al. | |
| 6,121,022 A | 9/2000 | Presta et al. | |
| 6,143,273 A | 11/2000 | Faure et al. | |
| 6,165,745 A | 12/2000 | Ward et al. | |
| 6,194,551 B1 | 2/2001 | Idusogie et al. | |
| 6,197,524 B1 | 3/2001 | Romagnani | |
| 6,207,156 B1 | 3/2001 | Kuchroo et al. | |
| 6,277,375 B1 | 8/2001 | Ward | |
| 6,383,492 B1 | 5/2002 | Srivastava et al. | |
| 6,391,306 B1 | 5/2002 | Srivastava et al. | |
| 6,403,095 B1 | 6/2002 | Srivastava et al. | |
| 6,410,026 B1 | 6/2002 | Srivastava | |
| 6,436,404 B1 | 8/2002 | Srivastava et al. | |
| 6,447,780 B1 | 9/2002 | Srivastava et al. | |
| 6,447,781 B1 | 9/2002 | Srivastava | |
| 6,503,184 B1 | 1/2003 | Ni et al. | |
| 6,509,173 B1 | 1/2003 | Ni et al. | |
| 6,610,659 B1 | 8/2003 | Pramod | |
| 6,645,495 B1 | 11/2003 | Kensil et al. | |
| 6,737,056 B1 | 5/2004 | Presta | |
| 6,808,710 B1 | 10/2004 | Wood et al. | |
| 7,025,962 B1 | 4/2006 | Gorman et al. | |
| 7,029,678 B2 | 4/2006 | Momin et al. | |
| 7,034,121 B2 | 4/2006 | Carreno et al. | |

(Continued)

FOREIGN PATENT DOCUMENTS

| | | |
|---|---|---|
| EP | 2100615 A1 | 9/2009 |
| EP | 2637691 A2 | 9/2013 |

(Continued)

OTHER PUBLICATIONS

Agenus, Agenus R&D Day—Driving the Immune System to Fight Cancer and Infectious Disease, Presented May 14, 2015, 93 slides.
Allan, S.E., et al., "Activation-induced FOXP3 in Human T Effector Cells Does Not Suppress Proliferation or Cytokine Production," International Immunology 19(4):345-354, Oxford University Press, England (2007).
Arnett, S.O., et al., "IBC's 21st Annual Antibody Engineering and 8th Annual Antibody Therapeutics International Conferences and 2010 Annual Meeting of The Antibody Society," mAbs 3(2):133-152, Taylor & Francis, United States (2011).

(Continued)

*Primary Examiner* — Ruixiang Li
(74) *Attorney, Agent, or Firm* — Sterne, Kessler, Goldstein & Fox P.L.L.C.

(57) ABSTRACT

The present disclosure provides antibodies that specifically bind to human glucocorticoid-induced TNFR family related receptor (GITR) and compositions comprising such antibodies. In a specific aspect, the antibodies specifically bind to human GITR and modulate GITR activity, e.g., enhance, activate or induce GITR activity, utilizing such antibodies. The present disclosure also provides methods for treating disorders, such as cancer and infectious diseases, by administering an antibody that specifically binds to human GITR and modulates GITR activity e.g., enhances, activates or induces GITR activity.

4 Claims, 55 Drawing Sheets

Specification includes a Sequence Listing.

(56) References Cited

U.S. PATENT DOCUMENTS

| | | | |
|---|---|---|---|
| 7,465,446 B2 | 12/2008 | Lowy et al. |
| 7,470,428 B2 | 12/2008 | Kuchroo et al. |
| 7,488,802 B2 | 2/2009 | Collins et al. |
| 7,531,170 B1 | 5/2009 | Croft et al. |
| 7,550,140 B2 | 6/2009 | Bakker et al. |
| 7,799,902 B2 | 9/2010 | Browning et al. |
| 7,807,156 B1 | 10/2010 | Croft et al. |
| 7,812,135 B2 | 10/2010 | Smith et al. |
| 7,858,589 B2 | 12/2010 | Kensil |
| 8,008,449 B2 | 8/2011 | Korman et al. |
| 8,101,176 B2 | 1/2012 | Kuchroo et al. |
| 8,114,845 B2 | 2/2012 | Langermann et al. |
| 8,142,778 B2 | 3/2012 | Davis et al. |
| 8,168,179 B2 | 5/2012 | Honjo et al. |
| 8,168,757 B2 | 5/2012 | Finnefrock et al. |
| 8,193,322 B2 | 6/2012 | Yan et al. |
| 8,226,946 B2 | 7/2012 | Chen et al. |
| 8,263,073 B2 | 9/2012 | Korman et al. |
| 8,283,450 B2 | 10/2012 | Kato et al. |
| 8,388,967 B2 | 3/2013 | Smith et al. |
| 8,409,577 B2 | 4/2013 | Thompson et al. |
| 8,541,002 B2 | 9/2013 | Truneh et al. |
| 8,591,886 B2 | 11/2013 | Ponath et al. |
| 8,614,295 B2 | 12/2013 | Lawson et al. |
| 8,709,424 B2 | 4/2014 | Schebye et al. |
| 9,005,619 B2 | 4/2015 | Kohrt et al. |
| 9,028,823 B2 | 5/2015 | Smith et al. |
| 9,119,807 B2 | 9/2015 | Aarvak et al. |
| 9,228,016 B2 | 1/2016 | Wang et al. |
| 9,241,992 B2 | 1/2016 | Ponte et al. |
| 9,255,151 B2 | 2/2016 | Kwon |
| 9,255,152 B2 | 2/2016 | Kwon |
| 9,309,321 B2 | 4/2016 | Kwon |
| 9,382,319 B2 | 7/2016 | Tso et al. |
| 9,464,139 B2 | 10/2016 | Beers et al. |
| 9,493,579 B2 | 11/2016 | Miller et al. |
| 9,834,610 B2 | 12/2017 | Tykocinski |
| 2002/0150993 A1 | 5/2002 | Ashkenazi et al. |
| 2003/0086930 A1 | 5/2003 | Mueller et al. |
| 2003/0133936 A1 | 7/2003 | Byrne et al. |
| 2003/0232323 A1 | 12/2003 | Freeman et al. |
| 2005/0014224 A1 | 1/2005 | Collins et al. |
| 2005/0048054 A1 | 3/2005 | Hanabuchi et al. |
| 2005/0226875 A1 | 10/2005 | Gomez-Navarro et al. |
| 2007/0243184 A1 | 10/2007 | Fischkoff et al. |
| 2008/0152665 A1 | 6/2008 | Leclerc et al. |
| 2009/0004213 A1 | 1/2009 | Singh et al. |
| 2009/0123477 A1 | 5/2009 | Hanke et al. |
| 2009/0214533 A1 | 8/2009 | Clynes |
| 2009/0285834 A1 | 11/2009 | Tomizawa |
| 2010/0061992 A1 | 3/2010 | Anderson et al. |
| 2010/0100131 A1 | 4/2010 | Wallenstein |
| 2010/0136030 A1 | 6/2010 | Salah-Eddine et al. |
| 2010/0196359 A1 | 8/2010 | Kato et al. |
| 2010/0196394 A1 | 8/2010 | Pardoll et al. |
| 2010/0203056 A1 | 8/2010 | Irving et al. |
| 2010/0233183 A1 | 9/2010 | Triebel et al. |
| 2010/0278844 A1 | 11/2010 | Balkwill et al. |
| 2010/0285001 A1 | 11/2010 | Land et al. |
| 2011/0044953 A1 | 2/2011 | Allison et al. |
| 2011/0150892 A1 | 6/2011 | Thudium et al. |
| 2011/0305713 A1 | 12/2011 | Munn et al. |
| 2012/0014947 A1 | 1/2012 | Fu |
| 2012/0141501 A1 | 6/2012 | Yoshida et al. |
| 2012/0142750 A1 | 6/2012 | Chen et al. |
| 2012/0219559 A1 | 8/2012 | Chen |
| 2013/0022623 A1 | 1/2013 | Karsunky et al. |
| 2013/0039911 A1 | 2/2013 | Bedi et al. |
| 2013/0108641 A1 | 5/2013 | Baurin et al. |
| 2013/0177579 A1 | 7/2013 | Lin et al. |
| 2013/0183315 A1 | 7/2013 | Attinger et al. |
| 2013/0202623 A1 | 8/2013 | Chomont et al. |
| 2013/0295107 A1 | 11/2013 | Tawara et al. |
| 2013/0323283 A1 | 12/2013 | Hancock et al. |
| 2014/0037621 A1 | 2/2014 | Tsurushita |
| 2014/0294759 A1 | 10/2014 | Chu et al. |
| 2014/0348841 A1 | 11/2014 | Schebye et al. |
| 2014/0377253 A1 | 12/2014 | Harding et al. |
| 2015/0037346 A1 | 2/2015 | Lesokhin et al. |
| 2015/0038682 A1 | 2/2015 | Tsurushita et al. |
| 2015/0056206 A1 | 2/2015 | Zhou |
| 2015/0064204 A1 | 3/2015 | Beers et al. |
| 2015/0086584 A1 | 3/2015 | Gilboa et al. |
| 2015/0174268 A1 | 6/2015 | Li |
| 2015/0210765 A1 | 7/2015 | Roschke et al. |
| 2015/0307620 A1 | 10/2015 | Vella et al. |
| 2015/0322119 A1 | 11/2015 | Engelhardt et al. |
| 2015/0368349 A1 | 12/2015 | Gonzalez et al. |
| 2015/0377882 A1 | 12/2015 | Ashdown |
| 2016/0151515 A1 | 6/2016 | Joubert et al. |
| 2016/0159905 A1 | 6/2016 | Abdiche et al. |
| 2016/0159927 A1 | 6/2016 | Molloy et al. |
| 2016/0304607 A1 | 10/2016 | Sadineni et al. |

FOREIGN PATENT DOCUMENTS

| | | |
|---|---|---|
| JP | 2008278814 A | 11/2008 |
| WO | WO-9429351 A2 | 12/1994 |
| WO | WO-9501997 A1 | 1/1995 |
| WO | WO-9734631 A1 | 9/1997 |
| WO | WO-9823289 A1 | 6/1998 |
| WO | WO-0037504 A2 | 6/2000 |
| WO | WO-0042072 A2 | 7/2000 |
| WO | WO-0114424 A2 | 3/2001 |
| WO | WO-2001-077342 A1 | 10/2001 |
| WO | WO-02060919 A2 | 8/2002 |
| WO | WO-2006105021 A2 | 10/2006 |
| WO | WO-2007133822 A1 | 11/2007 |
| WO | WO-2009100140 A1 | 8/2009 |
| WO | WO-2010005958 A2 | 1/2010 |
| WO | WO-2013033091 A1 | 3/2013 |
| WO | WO-2013039954 A1 | 3/2013 |
| WO | WO-2013049307 A2 | 4/2013 |
| WO | WO-2014-121099 A1 | 8/2014 |
| WO | WO-2015009856 A2 | 1/2015 |
| WO | WO-2015026684 A1 | 2/2015 |
| WO | WO-2015095811 A2 | 6/2015 |
| WO | WO-2015145360 A1 | 10/2015 |
| WO | WO-2015184099 A1 | 12/2015 |
| WO | WO-2016028656 A1 | 2/2016 |
| WO | WO-2016028672 A1 | 2/2016 |
| WO | WO-2016054638 A1 | 4/2016 |
| WO | WO-2016057841 A1 | 4/2016 |
| WO | WO-2016081746 A2 | 5/2016 |
| WO | WO-2016100985 A2 | 6/2016 |
| WO | WO-2016111645 A1 | 7/2016 |
| WO | WO-2016154544 A1 | 9/2016 |
| WO | WO-2016168716 A1 | 10/2016 |
| WO | WO-2017096179 A1 | 6/2017 |
| WO | WO-2017096189 A1 | 6/2017 |
| WO | WO-2017096276 A1 | 6/2017 |
| WO | WO-2018-089628 A1 | 5/2018 |

OTHER PUBLICATIONS

Avogadri, F., et al., "Modulation of CTLA-4 and GITR for Cancer Immunotherapy," Current Topics in Microbiology and Immunology 344:211-244, Springer Verlag, Germany (2011).

Baessler, T., et al., "Glucocorticoid-induced Tumor Necrosis Factor Receptor-related Protein Ligand Subverts Immunosurveillance of Acute Myeloid Leukemia in Humans," Cancer Research 69(3):1037-1045, American Association for Cancer Research, United States (2009).

Baltz, K.M., et al., "Cancer Immunoediting by GITR (Glucocorticoid-induced TNF-related Protein) Ligand in Humans: NK Cell/tumor Cell Interactions," FASEB Journal 21(10):2442-2454, The Federation, United States (2007).

Bellati, F., et al., "Immunology of Gynecologic Neoplasms: Analysis of the Prognostic Significance of the Immune Status," Current Cancer Drug Targets 9(4):541-565, Bentham Science Publishers, Netherlands (2009).

(56) References Cited

OTHER PUBLICATIONS

Bianchini, R., et al., "CD4(+) CD25(low) GITR(+) Cells: A Novel Human CD4(+) T-cell Population with Regulatory Activity," European Journal of Immunology 41(8):2269-2278, Wiley-VCH, Germany (2011).

Bossen, C., et al., "Interactions of Tumor Necrosis Factor (TNF) and TNF Receptor Family Members in the Mouse and Human," The Journal of Biological Chemistry 281(20):13964-13971, American Society for Biochemistry and Molecular Biology, United States (May 2006).

Bremnes, R.M., et al., "The Role of Tumor-infiltrating Immune Cells and Chronic Inflammation at the Tumor Site on Cancer Development, Progression, and Prognosis: Emphasis on Non-small Cell Lung Cancer," Journal of Thoracic Oncology 6(4):824-833, Elsevier, United States (2011).

Brennan, F.R., et al., "Safety and Immunotoxicity Assessment of Immunomodulatory Monoclonal Antibodies," mAbs 2(3):233-255, Taylor & Francis, United States (2010).

Bruhns, P., et al., "Specificity and Affinity of Human Fcgamma Receptors and Their Polymorphic Variants for Human IgG Subclasses," Blood 113(16):3716-3725, American Society of Hematology, United States (2009).

Buechele, C., et al., "Glucocorticoid-induced TNFR-related Protein (GITR) Ligand Modulates Cytokine Release and NK Cell Reactivity in Chronic Lymphocytic Leukemia (CLL)," Leukemia 26(5):991-1000, Nature Publishing Group, England (2012).

Bulliard, Y., et al., "Activating Fc γ Receptors Contribute to the Antitumor Activities of Immunoregulatory Receptor-targeting Antibodies," The Journal of Experimental Medicine 210(9)1685-1693, Rockefeller University Press, United States (2013).

Bulliard, Y., et al., "OX40 Engagement Depletes Intratumoral Tregs via Activating Fcγrs, Leading to Antitumor Efficacy," Immunology and Cell Biology 92(6):475-480, Nature Publishing Group, England (Apr. 2014).

Chan, A.C. and Carter, P.J., "Therapeutic Antibodies for Autoimmunity and Inflammation," Nature Reviews. Immunology 10(5):301-316, Macmillan Publishers Limited, England (2010).

Chang, W.J., et al, "Inflammation-related Factors Predicting Prognosis of Gastric Cancer," World Journal of Gastroenterology 20(16):4586-4596, Baishideng Publishing Group, United States (Apr. 2014).

Chapman, K., et al., "Preclinical Safety Testing of Monoclonal Antibodies: the Significance of Species Relevance," Nature Reviews. Drug Discovery 6(2):120-126, Nature Pub. Group, England (2007).

Chattopadhyay, K., et al, "Assembly and Structural Properties of Glucocorticoid-induced TNF Receptor Ligand: Implications for Function," Proceedings of the National Academy of Sciences USA 104(49):19452-19457, National Academy of Sciences, United States (2007).

Chen, D.S. and Mellman, I., "Oncology Meets Immunology: The Cancer-immunity Cycle," Immunity 39(1):1-10, Cell Press, United States (2013).

Chu, S.Y., et al., "Inhibition of B Cell Receptor-mediated Activation of Primary Human B cells by Coengagement of CD19 and FcgammaRIIb with Fc-Engineered Antibodies," Molecular Immunology 45(15):3926-3933, Pergamon Press, England (2008).

Clackson, T., et al., "Making Antibody Fragments using Phage Display Libraries," Nature 352(6336):624-628, Nature Publishing Group, England (Aug. 1991).

Clouthier, D.L. and Watts, T.H., "Cell-specific and Context-dependent Effects of GITR in Cancer, Autoimmunity, and Infection," Cytokine & Growth Factor Reviews 25(2):91-106, Elsevier Science, England (Jan. 2014).

Coe, D., et al., "Depletion of Regulatory T Cells by Anti-GITR mAb as a Novel Mechanism for Cancer Immunotherapy," Cancer Immunology, Immunotherapy 59(9):1367-1377, Springer International, Germany (2010).

Cohen, A.D., et al., "Agonist Anti-GITR Antibody Enhances Vaccine-induced CD8(+) T-cell Responses and Tumor Immunity," Cancer Research 66(9):4904-4912, American Association for Cancer Research, United States (2006).

Cohen, A.D., et al., "Agonist Anti-GITR Monoclonal Antibody Induces Melanoma Tumor Immunity in Mice by Altering Regulatory T Cell Stability and Intra-tumor Accumulation," PLoS One 5(5):e10436, Public Library of Science, United States (2010).

Coiffier, B., "Rituximab Therapy in Malignant Lymphoma," Oncogene 26(25):3603-3613, Nature Publishing Group, England (2007).

Cote, A.L., et al., "Stimulation of the Glucocorticoid-induced TNF Receptor Family-related Receptor on CD8 T Cells Induces Protective and High-avidity T Cell Responses to Tumor-specific Antigens," Journal of Immunology 186(1):275-283, American Association of Immunologists, United States (2011).

Croft, M., "The TNF Family in T Cell Differentiation and Function—unanswered Questions and Future Directions," Seminars in Immunology 26(3):183-190, W.B. Saunders, England (Jun. 2014).

Cui, D., et al., "An Isoleucine-zipper Motif Enhances Costimulation of Human Soluble Trimeric GITR Ligand," Cellular & Molecular Immunology 7(4):316-322, Nature Pub. Group, China (2010).

Cunningham, B.C. and Wells, J.A., "High-resolution Epitope Mapping of hGH-receptor Interactions by Alanine-scanning Mutagenesis," Science 244(4908):1081-1085, American Association for the Advancement of Science, United States (Jun. 1989).

Cuzzocrea, S., et al., "Genetic and Pharmacological Inhibition of GITR-GITRL Interaction Reduces Chronic Lung Injury Induced by Bleomycin Instillation," FASEB Journal 21(1):117-129, The Federation, United States (2007).

Cuzzocrea, S., et al., "Glucocorticoid-induced TNF Receptor Family Gene (GITR) Knockout Mice Exhibit a Resistance to Splanchnic Artery Occlusion (SAO) Shock," Journal of Leukocyte Biology 76(5):933-940, Society for Leukocyte Biology, United States (2004).

Cuzzocrea, S., et al., "Proinflammatory Role of Glucocorticoid-induced TNF Receptor-related Gene in Acute Lung Inflammation," Journal of Immunology 177(1):631-641, American Association of Immunologists, United States (2006).

Dall'Acqua, W.F., et al., "Properties of Human IgG1s Engineered for Enhanced Binding to the Neonatal Fc Receptor (FcRn)," The Journal of Biological Chemistry 281(33):23514-23524, American Society for Biochemistry and Molecular Biology, United States (2006).

Dangl, J.L., et al., "Segmental Flexibility and Complement Fixation of Genetically Engineered Chimeric Human, Rabbit and Mouse Antibodies," The EMBO Journal 7(7):1989-1994, Wiley Blackwell, England (1988).

Dunn, G.P., et al., "Cancer Immunoediting: From Immunosurveillance to Tumor Escape," Nature Immunology 3(11):991-998, Nature America Inc, United States (2002).

Dupage, M., et al., "Expression of Tumour-specific Antigens Underlies Cancer Immunoediting," Nature 482(7385):405-409, Nature Publishing Group, England (2012).

Esparza, E.M. and Arch, R.H., "Signaling Triggered by Glucocorticoid-induced Tumor Necrosis Factor Receptor Family-related Gene: Regulation at the Interface Between Regulatory T Cells and Immune Effector Cells," Frontiers in Bioscience 11:1448-1465, Frontiers in Bioscience Publications, United States (2006).

Finco, D., et al., "Cytokine Release Assays: Current Practices and Future Directions," Cytokine 66(2):143-155, Elsevier Science Ltd, England (Jan. 2014).

Furness, A.J., et al., "Impact of Tumour Microenvironment and Fc Receptors on the Activity of Immunomodulatory Antibodies," Trends in Immunology 35(7):290-298, Elsevier Science Ltd., England (Jul. 2014).

Galon, J., et al., "Type, Density, and Location of Immune Cells Within Human Colorectal Tumors Predict Clinical Outcome," Science 313(5795):1960-1964, American Association for the Advancement of Science, United States (2006).

GenBank, "*Homo sapiens* Glucocorticoid-induced TNFR-related Protein Ligand (TNFSF18) mRNA, Complete Cds," Accession No. AF125303.1, accessed at https://www.ncbi.nlm.nih.gov/nuccore/AF125303, Apr. 2, 1999.

(56) References Cited

OTHER PUBLICATIONS

GenBank, "*Homo sapiens* Tumor Necrosis Factor Receptor Superfamily, Member 18, mRNA (cDNA clone Image: 100013446)," Accession No. BC152386.1, accessed at https://www.ncbi.nlm.nih.gov/nuccore/BC152386, Oct. 30, 2007.
GenBank, "*Homo sapiens* Tumor Necrosis Factor Receptor Superfamily, member 18, mRNA (cDNA clone MGC:166936 IMAGE:100013440), Complete Cds," Accession No. Bci 52381.1, accessed at https://www.ncbi.nlm.nih.gov/nuccore/BC152381, Oct. 30, 2007.
GenBank, "Tumor Necrosis Factor Ligand Superfamily Member 18 [*Homo sapiens*]," Accession No. NP_005083.2 accessed at https://www.ncbi.nlm.nih.gov/protein/NP_005083, Oct. 6, 2016.
GenBank, "tumor necrosis factor receptor superfamily member 18 isoform 1 precursor [*Homo sapiens*]," Accession No. NP_004186.1, accessed at https://www.ncbi.nlm.nih.gov/protein/NP_004186, Oct. 7, 2016.
GenBank, "tumor necrosis factor receptor superfamily member 18 isoform 2 precursor [*Homo sapiens*]," Accession No. NP_683699.1, accessed at https://www.ncbi.nlm.nih.gov/protein/NP683699, Oct. 7, 2016.
GenBank, "tumor necrosis factor receptor superfamily member 18 isoform 3 precursor [*Homo sapiens*], " Accession No. NP_683700.1, accessed at https://www.ncbi.nlm.nih.gov/protein/NP683700, Oct. 7, 2016.
Gene ID: 8784 by Entrez Gene, TNFRSF18, accessed at https://www.ncbi.nlm.nih.gov/gene/8784, Feb. 20, 2017.
Gerondakis, S., et al., "NF-κB Control of T Cell Development," Nature Immunology 15(1):15-25, Nature America Inc., United States (Dec. 2013).
Glaus, C., et al., "In Vivo SPECT/CT Imaging of an Anti-GITR Antibody: A Novel Cancer Immunotherapeutic," The Journal of Nuclear Medicine 54(2):327, (2013).
Gobert, M., et al., "Regulatory T Cells Recruited through CCL22/CCR4 are Selectively Activated in Lymphoid Infiltrates Surrounding Primary Breast Tumors and Lead to an Adverse Clinical Outcome," Cancer Research 69(5):2000-2009, American Association for Cancer Research, United States (2009).
Goede, V., et al., "Obinutuzumab Plus Chlorambucil in Patients With CLL and Coexisting Conditions," The New England Journal of Medicine 370(12):1101-1110, Massachusetts Medical Society., United States (Mar. 2014).
Golay, J., et al., "Glycoengineered CD20 Antibody Obinutuzumab Activates Neutrophils and Mediates Phagocytosis Through CD16B More Efficiently Than Rituximab," Blood 122(20):3482-3491, American Society of Hematology, United States (2013).
Gonzalez, A.M., et al., "Abstract 3220: A Novel Agonist Antibody (INCAGN01876) That Targets the Costimulatory Receptor GITR," American Association for Cancer Research Annual Meeting 2016, Poster #3220. Presented Apr. 2016.
Gooden, M.J., et al., "The Prognostic Influence of Tumour-infiltrating Lymphocytes in Cancer: A Systematic Review With Meta-analysis," British Journal of Cancer 105(1):93-103, Nature Publishing Group, England (2011).
Grewal, I.S., "Overview of TNF Superfamily: A Chest Full of Potential Therapeutic Targets," Advances in Experimental Medicine and Biology 647:1-7, Kluwer Academic/Plenum Publishers, United States (2009).
Grohmann, U., et al., "Reverse Signaling Through GITR Ligand Enables Dexamethasone to Activate IDO in Allergy," Nature Medicine 13(5):579-586, Nature Publishing Company, United States (2007).
Grosso, J.F. and Jure-Kunkel, M.N., "CTLA-4 Blockade in Tumor Models: An Overview of Preclinical and Translational Research," Cancer Immunity 13:5, Cancer Research Institute, United States (2013).
Guilliams, M., et al., "Dendritic Cells, Monocytes and Macrophages: A Unified Nomenclature Based on Ontogeny," Nature Reviews. Immunology 14(8):571-578, Nature Pub. Group, England (Aug. 2014).
Gurney, A.L., et al., "Identification of a New Member of the Tumor Necrosis Factor Family and its Receptor, a Human Ortholog of Mouse GITR," Current Biology 9(4):215-218, Cell Press, England (1999).
Hanabuchi, S., et al., "Human Plasmacytoid Predendritic Cells Activate Nk Cells Through Glucocorticoid-induced Tumor Necrosis Factor Receptor-ligand (GITRL)," Blood 107(9):3617-3623, American Society of Hematology, United States (2006).
Herter, S., et al., "Glycoengineering of Therapeutic Antibodies Enhances Monocyte/macrophage-mediated Phagocytosis and Cytotoxicity," Journal of Immunology 192(5):2252-2260, American Association of Immunologists, United States (Mar. 2014).
Hulett, M.D., et al., "Multiple Regions of Human Fc Gamma RII (CD32) Contribute to the Binding of IgG," The Journal of Biological Chemistry 270(36):21188-21194, American Society for Biochemistry and Molecular Biology, United States (1995).
Imai-Nishiya, H., et al., "Double Knockdown of Alpha 1,6-Fucosyltransferase (FUT8) and GDP-Mannose 4,6-Dehydratase (GMD) in Antibody-Producing Cells: a New Strategy for Generating Fully Non-Fucosylated Therapeutic Antibodies With Enhanced ADCC," BMC Biotechnology 7:84, BioMed Central, England (2007).
IUPAC-IUB Joint Commission on Biochemical Nomenclature (JCBN). "Nomenclature and Symbolism for Amino Acids and Peptides. Recommendations 1983," The Biochemical Journal 219(2):345-373, Biochemical Society, England (1984).
Jacobsen, F.W., et al., "Molecular and Functional Characterization of Cynomolgus Monkey IgG Subclasses," Journal of Immunology 186(1):341-349, American Association of Immunologists, United States (2011).
Ji, H.B., et al., "Cutting Edge: the Natural Ligand for Glucocorticoid-induced TNF Receptor-related Protein Abrogates Regulatory T Cell Suppression," Journal of Immunology 172(10):5823-5827, American Association of Immunologists, United States (2004).
Kamb, A., et al., "Why Is Cancer Drug Discovery So Difficult?," Nature Reviews. Drug Discovery 6(2):115-120, Nature Pub. Group, England (2007).
Kim, I.K., et al., "Glucocorticoid-induced Tumor Necrosis Factor Receptor-related Protein Co-stimulation Facilitates Tumor Regression by Inducing IL-9-producing Helper T Cells," Nature Medicine 21(9):1010-1017, Nature Publishing Company, United States (Aug. 2015).
Kim, J.D., et al., "Cloning and Characterization of GITR Ligand," Genes and Immunity 4(8):564-569, Nature Pub. Group, England (2003).
Kim, J.M. and Ashkenazi, A., "Fcγ Receptors Enable Anticancer Action of Proapoptotic and Immune-modulatory Antibodies," The Journal of Experimental Medicine 210(9):1647-1651, Rockefeller University Press, United States (2013).
Kim, S.J., et al., "Guided Selection of Human Antibody Light Chains Against TAG-72 Using a Phage Display Chain Shuffling Approach," Journal of Microbiology 45(6):572-577, Microbiological Society of Korea, Korea (2007).
Kim, S.T., et al., "Tumor-infiltrating Lymphocytes, Tumor Characteristics, and Recurrence in Patients With Early Breast Cancer," American Journal of Clinical Oncology 36(3):224-231, Lippincott Williams & Wilkins, United States (2013).
Kim, W.J., et al., "Glucocorticoid-induced Tumour Necrosis Factor Receptor Family Related Protein (GITR) Mediates Inflammatory Activation of Macrophages that Can Destabilize Atherosclerotic Plaques," Immunology 119(3):421-429, Blackwell Scientific Publications, England (2006).
Kim, Y.H., et al., "Authentic GITR Signaling Fails To Induce Tumor Regression unless Foxp3γ Regulatory T Cells Are Depleted," Journal of Immunology 195(10):4721-4729, American Association of Immunologists, United States (Sep. 2015).
Kirk, R., "Risk Factors. CD8+:FOXP3+ Cell Ratio is a Novel Survival Marker for Colorectal Cancer," Nature Reviews. Clinical Oncology 7(6):299, Nature Pub. Group, England (2010).
Knee, D.A., et al., "Rationale for Anti-GITR Cancer Immunotherapy," European Journal of Cancer 67: 1-10, Elsevier Science (2016).
Ko, K., et al., "Treatment of Advanced Tumors with Agonistic Anti-GITR Mab and Its Effects On Tumor-infiltrating Foxp3+Cd25+

(56) References Cited

OTHER PUBLICATIONS

Cd4+ Regulatory T Cells," The Journal of Experimental Medicine 202(7):885-891, Rockefeller University Press, United States (Oct. 2005).
Kober, J., et al., "The Capacity of the TNF Family Members 4-1BBL, OX4OL, CD70, GITRL, CD30L and LIGHT to Costimulate Human T Cells," European Journal of Immunology 38(10):2678-2688, Wiley-VCH, Germany (2008).
Krausz, L.T., et al., "GITR-GITRL System, A Novel Player in Shock and Inflammation," The Scientific World Journal 7:533-566, Hindawi Publishing Corporation, United States (2007).
Kwon, B., et al., "Identification of a Novel Activation-inducible Protein of the Tumor Necrosis Factor Receptor Superfamily and Its Ligand," The Journal of Biological Chemistry 274(10):6056-6061, American Society for Biochemistry and Molecular Biology, United States (1999).
Lacal, P.M., et al., "Glucocorticoid-induced Tumor Necrosis Factor Receptor Family-related Ligand Triggering Upregulates Vascular Cell Adhesion Molecule-1 and Intercellular Adhesion Molecule-1 and Promotes Leukocyte Adhesion," The Journal of Pharmacology and Experimental Therapeutics 347(1):164-172, American Society for Pharmacology and Experimental Therapeutics, United States (2013).
Leach, D.R., et al., "Enhancement of Antitumor Immunity by CTLA-4 blockade," Science 271(5256):1734-1736, American Association for the Advancement of Science, United States (Mar. 1996).
Levings, M.K., et al., "Human CD25+CD4+ T Suppressor Cell Clones Produce Transforming Growth Factor Beta, but Not Interleukin 10, and Are Distinct From Type 1 T Regulatory Cells," The Journal of Experimental Medicine 196(10):1335-1346, Rockefeller University Press, United States (2002).
Li, F. and Ravetch, J.V., "Inhibitory Fcγ Receptor Engagement Drives Adjuvant and Anti-tumor Activities of Agonistic CD40 Antibodies," Science 333(6045):1030-1034, American Association for the Advancement of Science, United States (2011).
Li, Z., et al., "Expression of Glucocorticoid Induced TNF Receptor Family Related Protein (GITR) on Peripheral T Cells From Normal Human Donors and Patients with Non-infectious Uveitis," Journal of Autoimmunity 21(1):83-92, Academic Press, England (2003).
Liao, G., et al., "Glucocorticoid-Induced TNF Receptor Family-Related Protein Ligand is Requisite for Optimal Functioning of Regulatory CD4(+) T Cells," Frontiers in Immunology 5:35, Frontiers Research, Switzerland (Feb. 2014).
Liu, F., et al., "CD8+ Cytotoxic T Cell and FOXP3+ Regulatory T Cell Infiltration in Relation to Breast Cancer Survival and Molecular Subtypes," Breast Cancer Research and Treatment 130(2):645-655, Kluwer Academic, Netherlands (2011).
Li-Weber, M. and Krammer, P.H., "Regulation of IL4 Gene Expression by T Cells and Therapeutic Perspectives," Nature Reviews. Immunology 3(7):534-543, Nature Pub. Group, England (2003).
Locksley, R.M., et al., "the TNF and TNF Receptor Superfamilies: Integrating Mammalian Biology," Cell 104(4):487-501, Cell Press, United States (Feb. 2001).
Lu, L., et al., "Combined PD-1 Blockade and GITR Triggering Induce a Potent Antitumor Immunity in Murine Cancer Models and Synergizes with Chemotherapeutic Drugs," Journal of Translational Medicine 12: 11 pages, BioMed Central, England (Feb. 2014).
Mahne, A.E., et al., "Dual Roles for Regulatory T-cell Depletion and Costimulatory Signaling in Agonistic GITR Targeting for Tumor Immunotherapy," Cancer Research 77(5):1108-1118, American Association for Cancer Research, United States (2017).
Mathai, A.M., et al., "Role of Foxp3-positive Tumor-infiltrating Lymphocytes in the Histologic Features and Clinical Outcomes of Hepatocellular Carcinoma," The American Journal of Surgical Pathology 36(7):980-986, Wolters Kluwer Health, Inc, United States (2012).
Matsushita, H., et al., "Cancer Exome Analysis Reveals a T-cell-dependent Mechanism of Cancer Immunoediting," Nature 482(7385):400-404, Nature Publishing Group, England (2012).

McHugh, R.S., et al., "CD4(+)CD25(+) Immunoregulatory T Cells: Gene Expression Analysis Reveals a Functional Role for the Glucocorticoid-induced TNF Receptor," Immunity 16(2):311-323, Cell Press, United States (2002).
Mei, Z., et al., "Tumour-infiltrating Inflammation and Prognosis in Colorectal Cancer: Systematic Review and Meta-analysis ," British Journal of Cancer 110(6):1595-1605, Cancer Research UK, England (Feb. 2014).
Melero, I., et al., "Agonist Antibodies to TNFR Molecules that Costimulate T and NK Cells," Clinical Cancer Research 19(5):1044-1053, The Association, United States (2013).
Mellman, I., et al., "Cancer Immunotherapy Comes of Age," Nature 480(7378):480-489, Nature Publishing Group, England (Dec. 2011).
Mimoto, F., et al., "Engineered Antibody Fc Variant with Selectively Enhanced FcγRIIb Binding Over both FcγRIIa(R131) and FcγRIIa(H131)," Protein Engineering, Design & Selection 26(10):589-598, Oxford University Press, England (2013).
Mitsui, J., et al., "Two Distinct Mechanisms of Augmented Antitumor Activity by Modulation of Immunostimulatory/inhibitory Signals," Clinical Cancer Research 16(10):2781-2791, The Association, United States (2010).
Moreau, T., et al., "Transient Increase in Symptoms Associated With Cytokine Release in Patients With Multiple Sclerosis," Brain 119( Pt 1):225-237, Oxford University Press, England (1996).
Murphy, J.T., et al., "Anaphylaxis Caused by Repetitive Doses of a GITR Agonist Monoclonal Antibody in Mice," Blood 123(14):2172-2180, American Society of Hematology, United States (Feb. 2014).
Nimmerjahn, F. and Ravetch, J.V., "Antibodies, Fc Receptors and Cancer," Current Opinion in Immunology 19(2):239-245, Elsevier, England (2007).
Nimmerjahn, F. and Ravetch, J.V., "Fcgamma Receptors: Old Friends and New Family Members," Immunity 24(1):19-28, Cell Press, United States (2006).
Nimmerjahn, F. and Ravetch, J.V., "Translating Basic Mechanisms of IgG Effector Activity Into Next Generation Cancer Therapies," Cancer Immunity 12:13, Cancer Research Institute, United States (2012).
Nishioka, T., et al., "In Vivo Expansion of CD4+Foxp3+ regulatory T Cells Mediated by GITR Molecules," Immunology Letters 121(2):97-104, Elsevier/North-Holland Biomedical Press, Netherlands (2008).
Nocentini, G. and Riccardi, C., "GITR: A Modulator of Immune Response and Inflammation," Advances in Experimental Medicine and Biology 647:156-173, Kluwer Academic/Plenum Publishers, United States (2009).
Nocentini, G. and Riccardi, C., "GITR: A Multifaceted Regulator of Immunity Belonging to the Tumor Necrosis Factor Receptor Superfamily," European Journal of Immunology 35(4):1016-1022, Wiley-VCH, Germany (2005).
Nocentini, G., et al., "A New Member of the Tumor Necrosis Factor/Nerve Growth Factor Receptor Family Inhibits T Cell Receptor-induced Apoptosis," Proceedings of the National Academy of Sciences USA 94(12):6216-6221, National Academy of Sciences, United States (Jun. 1997).
Nocentini, G., et al., "GITR/GITRL: More Than an Effector T Cell Co-stimulatory System.," European Journal of Immunology 37(5):1165-1169, Wiley-VCH, Germany (2007).
Nocentini, G., et al., "Pharmacological Modulation of GITRL/GITR System: Therapeutic Perspectives," British Journal of Pharmacology 165(7):2089-2099, Wiley, England (2012).
Nosho, K., et al., "Tumour-infiltrating T-cell Subsets, Molecular Changes in Colorectal Cancer, and Prognosis: Cohort Study and Literature Review," The Journal of Pathology 222(4):350-366, John Wiley and Sons, England (2010).
Oble, D.A., et al., "Focus on TILs: Prognostic Significance of Tumor Infiltrating Lymphocytes in Human Melanoma," Cancer Immunity 9:3, Cancer Research Institute, United States (2009).
Oken, M.M., et al., "Toxicity and Response Criteria of the Eastern Cooperative Oncology Group," American Journal of Clinical Oncology 5(6):649-655, Lippincott Williams & Wilkins, United States (1982).
Ono, M., et al., "Control of Autoimmune Myocarditis and Multiorgan Inflammation by Glucocorticoid-induced TNF Receptor Family-related Protein(high), Foxp3-expressing CD25+ and CD25− Regu-

(56) References Cited

OTHER PUBLICATIONS latory T Cells," Journal of Immunology 176(8):4748-4756, American Association of Immunologists, United States (2006).
Patel, M.A., et al., "Agonist Anti-GITR Monoclonal Antibody and Stereotactic Radiation Induce Immune-mediated Survival Advantage in Murine Intracranial Glioma," Journal for Immunotherapy of Cancer 4:28, BioMed Central, England (2016).
Oncomed Pharmaceuticals, "OncoMed Presents Immuno-Oncology Data for GITRL-Fc Candidate at the Inaugural International Cancer Immunotherapy Conference," (Sep. 2015).
Piao, J., et al., "Enhancement of T-cell-mediated Anti-tumour Immunity via the Ectopically Expressed Glucocorticoid-induced Tumour Necrosis Factor Receptor-related Receptor Ligand (GITRL) on Tumours," Immunology 127(4):489-499, Blackwell Scientific Publications, England (2009).
Placke, T., et al., "Glucocorticoid-induced Tnfr-related (GITR) Protein and Its Ligand in Antitumor Immunity: Functional Role and Therapeutic Modulation," Clinical and Developmental Immunology, 10 pages, Hindawi Publishing Corporation, Egypt (2010).
Ponte, J.F., et al., "Enhancement of Humoral and Cellular Immunity With an Anti-glucocorticoid-induced Tumour Necrosis Factor Receptor Monoclonal Antibody," Immunology 130(2):231-242, Blackwell Scientific Publications, England (2010).
Presta, L.G., "Molecular Engineering and Design of Therapeutic Antibodies," Current Opinion in Immunology 20(4):460-470, Elsevier, England (2008).
Preston, C.C., et al., "The Ratios of CD8+ T Cells to CD4+CD25+ FOXP3+ and FOXP3− T Cells Correlate with Poor Clinical Outcome in Human Serous Ovarian Cancer," PLoS One 8(11):e80063, Public Library of Science, United States (2013).
R & D Systems, "Human GITR/TNFRSF18 Antibody," Monoclonal Mouse IgG1 Clone # 110416, accessed at: https://resources.rndsystems.com/pdfs/datasheets/mab689.pdf, dated Jun. 10, 2010, 1 page.
Rader, C., et al., "A Phage Display Approach for Rapid Antibody Humanization: Designed Combinatorial V Gene Libraries," Proceedings of the National Academy of Sciences USA 95(15):8910-8915, National Academy of Sciences, United States (Jul. 1998).
Ramirez-Montagut, T., et al., "Glucocorticoid-induced TNF Receptor Family Related Gene Activation Overcomes Tolerance/ignorance to Melanoma Differentiation Antigens and Enhances Antitumor Immunity," Journal of Immunology 176(11):6434-6442, American Association of Immunologists, United States (2006).
Ravetch, J.V. and Lanier, L.L., "Immune Inhibitory Receptors," Science 290(5489):84-89, American Association for the Advancement of Science, United States (2000).
Ronchetti, S., et al., "CD8+ T Cells: GITR Matters," The Scientific World Journal 2012:308265, Hindawi Publishing Corporation, United States (2012).
Ronchetti, S., et al., "GITR, a Member of the TNF Receptor Superfamily, is Costimulatory to Mouse T Lymphocyte Subpopulations," European Journal of Immunology 34(3):613-622, Wiley-VCH, Germany (2004).
Ronchetti, S., et al., "Glucocorticoid-induced Tumour Necrosis Factor Receptor-related Protein: A Key Marker of Functional Regulatory T Cells," Journal of Immunology Research 2015:171520, Hindawi Publishing Corporation, Egypt (May 2015).
Ronchetti, S., et al., "Role of GITR in Activation Response of T Lymphocytes," Blood 100(1):350-352, American Society of Hematology, United States (2002).
Rosenzweig, M., et al., "Development of TRX518, An Aglycosyl Humanized Monoclonal Antibody (Mab) Agonist of huGITR," ASCO Annual Meeting (2010).
Salgado, R., et al., "The Evaluation of Tumor-infiltrating Lymphocytes (TILs) in Breast Cancer: Recommendations by an International TILs Working Group 2014," Annals of Oncology 26(2):259-271, Oxford University Press, England (Sep. 2014).
Schaer, D.A., et al., "GITR Pathway Activation Abrogates Tumor Immune Suppression Through Loss of Regulatory T Cell Lineage Stability," Cancer Immunology Research 1(5):320-331, American Association for Cancer Research, United States (2013).

Schaer, D.A., et al., "Modulation of GITR for Cancer Immunotherapy," Current Opinion in Immunology 24(2):217-224, Elsevier Ltd., England (Apr. 2012).
Schaer, D.A., et al., "Targeting Tumor-necrosis Factor Receptor Pathways for Tumor Immunotherapy," Journal for Immunotherapy of Cancer 2:7, BioMed Central, England (Apr. 2014).
Schwende, H., et al., "Differences in the State of Differentiation of THP-1 Cells Induced by Phorbol Ester and 1,25-dihydroxyvitamin D3," Journal of Leukocyte Biology 59(4):555-561, Society for Leukocyte Biology, United States (1996).
Selby, M.J., et al., "Anti-CTLA-4 Antibodies of IgG2a Isotype Enhance Antitumor Activity through Reduction of Intratumoral Regulatory T Cells," Cancer Immunology Research 1(1):32-42, American Association for Cancer Research, United States (2013).
Shevach., E.M. and Stephens, G.L., "The GITR-GITRL Interaction: Co-stimulation or Contrasuppression of Regulatory Activity?," Nature Reviews Immunology 6(8):613-618, Nature Publishing Group, England (2006).
Shimizu, J., et al., "Stimulation of CD25(+)CD4(+) Regulatory T Cells through GITR Breaks Immunological Self-Tolerance," Nature Immunology 3(2):135-142, Nature America Inc., United States (2002).
Shirabe, K., et al., "Tumor-infiltrating Lymphocytes and Hepatocellular Carcinoma: Pathology and Clinical Management," International Journal of Clinical Oncology 15(6):552-558, Springer-Verlag Tokyo, Japan (2010).
Simpson, T.R., et al., "Fc-Dependent Depletion of Tumor-Infiltrating Regulatory T Cells o-Defines the Efficacy of Anti-CTLA-4 Therapy Against Melanoma," Journal of Experimental Medicine 210(9):1695-1710, The Rockefeller University Press, United States (2013).
Smith, C.A., et al., "The TNF Receptor Superfamily of Cellular and Viral Proteins: Activation, Costimulation, and Death," Cell 76(6):959-962, Cell Press, United States (Mar. 1994).
Smith, P., et al., "Mouse Model Recapitulating Human Fcγ Receptor Structural and Functional Diversity," Proceedings of the National Academy of Sciences of the United States of America 109(16):6181-6186, National Academy of Sciences, United States (2012).
Smyth, M.J., et al., "Targeting Regulatory T Cells in Tumor Immunotherapy," Immunology and Cell Biology 92(6):473-474, Nature Publishing Group, England (Apr. 2014).
Snell, L.M., et al., "CD8 T Cell-intrinsic GITR Is Required for T Cell Clonal Expansion and Mouse Survival Following Severe Influenza Infection," Journal of Immunology 185(12):7223-7234, American Association of Immunologists, United States (2010)—including Supplemental Data.
Snell, L.M., et al., "T-cell Intrinsic Effects of GITR and 4-1BB during Viral Infection and Cancer Immunotherapy," Immunological Reviews 244(1):197-217, Blackwell, England (2011).
Stebbings, R., et al., ""Cytokine Storm" in the Phase I Trial of Monoclonal Antibody TGN1412: Better Understanding the Causes to Improve Preclinical Testing of Immunotherapeutics," Journal of Immunology 179(5):3325-3331, American Association of Immunologists, United States (2007).
Stephens, G.L., et al., "Engagement of Glucocorticoid-induced TNFR Family-related Receptor on Effector T Cells by its Ligand Mediates Resistance to Suppression by CD4+CD25+ T Cells," Journal of Immunology 173(8):5008-5020, American Association of Immunologists, United States (2004).
Strohl, W.R., "Optimization of Fc-mediated Effector Functions of Monoclonal Antibodies," Current Opinion in Biotechnology 20(6):685-691, Elsevier, England (2009).
Swiss-Prot Accession No. Q9UNG2 (TNF18_HUMAN), accessed at http://www.uniprot.org/uniprot/Q9UNG2, Last modified Feb. 15, 2017.
Swiss-Prot Accession No. Q9Y5U5-1 (TNR18_HUMAN), accessed at http://www.uniprot.org/uniprot/Q9Y5U5#Q9Y5U5-1, Last Modified Nov. 1, 1999.
Swiss-Prot Accession No. Q9Y5U5-2 (TNR18_HUMAN), accessed at http://www.uniprot.org/uniprot/Q9Y5U5#Q9Y5U5-2.
Swiss-Prot Accession No. Q9Y5U5-3 (TNR18_HUMAN), accessed at http://www.uniprot.org/uniprot/Q9Y5U5#Q9Y5U5-3.

(56) References Cited

OTHER PUBLICATIONS

Talmadge, J.E., "Immune Cell Infiltration of Primary and Metastatic Lesions: Mechanisms and Clinical Impact," Seminars in Cancer Biology 21(2):131-138, W.B. Saunders Co., England (2011).
Tian, J., et al., "Up-regulation of GITRL on Dendritic Cells by WGP Improves Anti-tumor Immunity in Murine Lewis Lung Carcinoma," PLoS One 7(10):e46936, Public Library of Science, United States (2012).
Tone., M., et al., "Mouse Glucocorticoid-induced Tumor Necrosis Factor Receptor Ligand Is Costimulatory for T Cells," Proceedings of the National Academy of Sciences USA 100(25):15059-15064, National Academy of Sciences, United States (2003).
Tone, Y., et al., "Gene Expression in the GITR Locus is Regulated by NF-κB and Foxp3 Through an Enhancer," Journal of Immunology 192(8):3915-3924, American Association of Immunologists, United States (Apr. 2014).
Turk, M.J., et al., "Concomitant Tumor Immunity to a Poorly Immunogenic Melanoma Is Prevented by Regulatory T Cells," The Journal of Experimental Medicine 200(6):771-782, Rockefeller University Press, United States (2004).
Van Olffen, R.W., et al., "GITR Triggering Induces Expansion of Both Effector and Regulatory CD4+ T Cells in Vivo," Journal of Immunology 182(12):7490-7500, American Association of Immunologists, United States (2009).
Vessillier, S., et al., "Cytokine Release Assays for the Prediction of Therapeutic mAb Safety in First-in Man Trials-Whole Blood Cytokine Release Assays Are Poorly Predictive for TGN1412 Cytokine Storm," Journal of Immunological Methods 424:43-52, Elsevier, Netherlands (May 2015).
Vidal, J.M., et al., "In Vitro Cytokine Release Assays for Predicting Cytokine Release Syndrome: The Current State-of-the-science. Report of a European Medicines Agency Workshop," Cytokine 51(2):213-215, Elsevier, Netherlands (2010).
Waight, J.D., et al., "Cutting Edge: Epigenetic Regulation of Foxp3 Defines a Stable Population of CD4+ Regulatory T Cells in Tumors from Mice and Humans," Journal of Immunology 194(3):878-882, American Association of Immunologists, United States (Dec. 2014).
Warncke, M., et al., "Different Adaptations of IgG Effector Function in Human and Nonhuman Primates and Implications for Therapeutic Antibody Treatment," Journal of Immunology 188(9):4405-4411, American Association of Immunologists, United States (2012).
Watts, T.H., "TNF/TNFR Family Members in Costimulation of T Cell Responses," Annual Review of Immunology 23:23-68, Annual Reviews Incorporation, United States (2005).
Wells, J.A., "Systematic Mutational Analyses of Protein-protein Interfaces," Methods in Enzymology 202:390-411, Academic Press, United States (1991).
Weng, W.K., et al., "Two Immunoglobulin G Fragment C Receptor Polymorphisms Independently Predict Response to Rituximab in Patients with Follicular Lymphoma," Journal of Clinical Oncology 21(21):3940-3947, American Society of Clinical Oncology, United States (2003).
White, A.L., et al., "Conformation of the human immunoglobulin G2 hinge imparts superagonistic properties to immunostimulatory anticancer antibodies," Cancer Cell 27(1):138-148, Cell Press, United States (Jan. 2015).
White, A.L., et al., "Interaction with FcγRIIB is Critical for the Agonistic Activity of Anti-CD40 Monoclonal Antibody," Journal of Immunology 187(4):1754-1763, American Association of Immunologists, United States (2011).
Wilson, N.S. and Villadangos, J.A., "Regulation of Antigen Presentation and Cross-presentation in the Dendritic Cell Network: Facts, Hypothesis, and Immunological Implications," Advances in Immunology 86:241-305, Academic Press, United States (2005).
Wilson, N.S., et al., "An Fcγ Receptor-dependent Mechanism Drives Antibody-mediated Target-receptor Signaling in Cancer Cells," Cancer Cell 19(1):101-113, Cell Press, United States (2011).
Wing, K., et al., "CTLA-4 Control Over Foxp3+ Regulatory T Cell Function," Science 322(5899):271-275, American Association for the Advancement of Science, United States (2008).
Wolchok, J.D. and Saenger, Y., "The Mechanism of Anti-CTLA-4 Activity and The Negative Regulation of T-cell Activation," Oncologist 13(4):2-9, AlphaMed Press, United States (2008).
Wolchok, J.D., et al., "Guidelines for the Evaluation of Immune Therapy Activity in Solid Tumors: Immune-related Response Criteria," Clinical Cancer Research 15(23):7412-7420, The Association, United States (2009).
Wolf, B., et al., "A Whole Blood in Vitro Cytokine Release Assay With Aqueous Monoclonal Antibody Presentation for the Prediction of Therapeutic Protein Induced Cytokine Release Syndrome in Humans," Cytokine 60(3):828-837, Elsevier Science Ltd, England (2012).
Xie, P., "TRAF Molecules in Cell Signaling and in Human Diseases," Journal of Molecular Signaling 8(1):7, BioMed Central, England (2013).
Yao, S., et al., "Advances in Targeting Cell Surface Signalling Molecules for Immune Modulation," Nature Reviews. Drug Discovery 12(2):130-146, Nature Pub. Group, England (2013).
Yoon, H.H., et al., "Prognostic Impact of FoxP3+ Regulatory T Cells in Relation to CD8+ T Lymphocyte Density in Human Colon Carcinomas," PLoS One 7(8):e42274, Public Library of Science, United States (2012).
Yu, K.Y., et al., "Identification of a Ligand for Glucocorticoid-induced Tumor Necrosis Factor Receptor Constitutively Expressed in Dendritic Cells," Biochemical and Biophysical Research Communications 310(2):433-438, Elsevier, United States (2003).
Zhan, Y., et al., "Glucocorticoid-induced TNF Receptor Expression by T Cells is Reciprocally Regulated by NF-kappaB and NFAT," Journal of Immunology 181(8):5405-5413, American Association of Immunologists, United States (2008).
Zhang, H.H., et al., "Regulatory T Cell Depletion Enhances Tumor Specific CD8 T-cell Responses, Elicited by Tumor Antigen NY-ESO-1b in Hepatocellular Carcinoma Patients, in Vitro," International Journal of Oncology 36(4):841-848, Lychnia, Greece (2010).
Zhou, P., et al., "Mature B Cells Are Critical to T-cell-mediated Tumor Immunity Induced by an Agonist Anti-GITR Monoclonal Antibody," Journal of immunotherapy 33(8):789-797, Lippincott Williams & Wilkins, United States (2010).
Zhou, Z., et al., "Human Glucocorticoid-induced TNF Receptor Ligand Regulates Its Signaling Activity Through Multiple Oligomerization States," Proceedings of the National Academy of Sciences USA 105(14):5465-5470, National Academy of Sciences, United States (2008).
Zipfel, P.F. and Skerka, C., "Complement Regulators and Inhibitory Proteins," Nature Reviews. Immunology 9(10):729-740, Nature Pub. Group, England (2009).
Zou, W., "Regulatory T Cells, Tumour Immunity and Immunotherapy," Nature Reviews. Immunology 6(4):295-307, Nature Pub. Group, England (2006).
International Preliminary Report on Patentability and Written Opinion for International Application No. PCT/US2015/032895, The International Bureau of WIPO, Geneva, Switzerland, dated Nov. 29, 2016, 8 pages.
International Search Report for International Application No. PCT/US2015/032895, European Patent Office, Netherlands, dated Oct. 21, 2015, 8 pages.
Tran Janco, J.M., "Tumor-Infiltrating Dendritic Cells in Cancer Pathogenesis," *The Journal of Immunology* 194:2985-2991, The American Association of Immunologists, Inc., United States (Mar. 20, 2015).
Gonzalez, A.M., et al., "INCAGN01876, A Unique GITR Agonist Antibody That Facilitates GITR Oligomerization," American Association for Cancer Research Annual Meeting 2017, Poster #3643. Presented Apr. 2017.
Gonzalez, A.M., et al., "A Novel Agonist Antibody (INCAGN01876) That Targets the Costimulatory Receptor GITR," American Association for Cancer Research Annual Meeting 2016, Poster #3220. Presented Apr. 2016.
English language translation of JP-2008278814-A, EPO and Google translate, Apr. 16, 2018.
Search Report and Written Opinion for Singaporean Patent Application No. 11201609721W, Intellectual Property Office of Singapore, Singapore, dated Apr. 17, 2018, 13 pages.

(56) References Cited

OTHER PUBLICATIONS

Birebent, Brigitte et al., "Suppressive Properties of Human CD25+ CD4+ Regulatory T Cells Are Dependent on CTLA-4 Expression," Eur J Immunol 34:3485-3496. (2004).

Park, Moon Soo, "The Role of AITR and AITRL in the Lumbar Disc Herniation," Yonsei University Department of Medicine. See Figures and English Abstract, (2005).

eBioscience, an Affymetrix Company "Anti-Human CD357 (AITR/GITR) PE," Product Brochure. Catalog No. 12-5875, (2012).

Herber, Donna L. et al., "Meeting Report: Mechanism and Therapeutic Reversal of Immune Suppression in Cancer," Cancer Res. 67(11):5067-5069, (2007).

Kanamaru, Fumiko et al., "Costimulation via Glucocorticoid-Induced TNF Receptor in Both Conventional and CD25+ Redgulatory CD4+ T Cells," J Immunol 172:7306-7314, (2004).

Ko, Hyun-Jeong et al., "A Combination of Chemoimmunotherapies Can Efficiently Break Self-Tolerance and Induce Antitumor Immunity in a Tolerogenic Murine Tumor Model," Cancer Res 67(15):7477-7486, (2007).

Miltenyi Biotec "Human Anti-GITR Antibodies," Product Brochure. Catalog Nos. 130-092-895, 130-092-575, 130-092-886, and 130-092-885, (2012).

Valzasina, Barbara et al. "Triggering of OX40 (CD134) on CD4+ CD25+ T Cells Blocks Their Inhibitory Activity: a Novel Regulatory Role for OX40 and its Comparison with GITR," Blood 105(7):2845-2851, (Dec. 9, 2004).

Zheng, Song Guo et al. "Natural and Induced CD4+CD25+ Cells Educate CD4+CD25− Cells to Develop Suppressive Activity: The Role of IL-2, TGF-β, and IL-10," J Immunol 172:5213-5221, (2004).

Co-pending U.S. Appl. No. 15/962,673, Gonzalez et al., filed Apr. 25, 2018 (Not Published).

Co-pending U.S. Appl. No. 15/962,752, Gonzalez et al., filed Apr. 25, 2018 (Not Published).

Co-pending U.S. Appl. No. 15/781,043, Wilson et al., filed Jun. 1, 2018 (Not Published).

Co-pending U.S. Appl. No. 15/781,051, Wilson et al., filed Jun. 1, 2018 (Not Published).

Hogarth PM et al. "Fc receptor-targeted therapies for the treatment of inflammation, cancer and beyond" Nat. Rev. Drug Discov. 11(4):311-31 (2012).

Ehrenstein MR et al., "The importance of natural IgM: scavenger, protector and regulator" Nat. Rev. Immunol. 10(11):778-86 (2010).

FIGURE 22A

| Numbering Scheme | | FR1 | | CDR1 | | | | | FR2 | | | | CDR2 | | | | | | | | | | | | | | | | FR3 | | | SEQ ID NO: |
|---|---|---|---|---|---|---|---|---|---|---|---|---|---|---|---|---|---|---|---|---|---|---|---|---|---|---|---|---|---|---|---|---|---|
| IMGT | 9 | 25 | 32 | 33 | 34 | 39 | 40 | 50 | 53 | 55 | 56 | 57 | 58 | 59 | 60 | 61 | 62 | 63 | 66 | 67 | 68 | 69 | 70 | 71 | 72 | 74 | 76 | 82 | |
| Kabat | H9 | H24 | H31 | H32 | H33 | H34 | H35 | H45 | H48 | H50 | H51 | H52 | H52A | H53 | H54 | H55 | H56 | H57 | H58 | H59 | H60 | H61 | H62 | H63 | H64 | H65 | H67 | H73 | |
| hum231-32-15VH | A | G | D | Y | A | M | Y | L | I | V | I | R | T | Y | S | G | D | V | T | Y | N | Q | K | F | K | D | A | K | 37 |
| Design of ML38 | | | | | | | | | | | | | | | | | | | | | | | | | | | | | | 38 |
| | X1 | X2 | X3 | X4 | X5 | | | X6 | X7 | X8 | | X9 | | X10 | | | X11 | X12 | X13 | | | X14 | X15 | | | | X16 | X17 | |
| | A | G | D | Y | A | M | Y | L | I | V | I | R | T | Y | S | G | D | V | T | Y | N | Q | K | F | K | D | A | K | |
| | T | A | E | V | | | H | M | M | L | | K | | F | | | E | L | S | | | R | E | | | | V | T | |
| | | | G | | | | | | | | | Q | | | | | G | | | | | | Q | | | | | | |
| Variant D03 | A | A | G | Y | A | M | Y | M | I | L | I | R | T | Y | S | G | G | V | T | Y | N | Q | K | F | Q | G | V | T | 39 |
| D05 | A | G | G | Y | A | M | Y | M | I | V | I | R | T | F | S | G | D | V | T | Y | N | Q | K | F | R | G | V | T | 40 |
| D07 | T | G | E | Y | A | M | Y | L | I | L | I | R | T | F | S | G | E | V | T | Y | N | Q | K | F | K | D | V | T | 41 |
| D08 | T | G | G | Y | A | M | Y | L | I | L | I | K | T | Y | S | G | G | V | S | Y | N | Q | K | F | R | G | V | K | 42 |
| D09 | A | G | G | Y | A | M | H | L | M | L | I | R | T | Y | S | G | G | V | T | Y | N | Q | K | F | R | E | A | T | 43 |
| E01 | T | A | E | Y | A | M | Y | L | I | L | I | R | T | Y | F | G | D | L | T | Y | N | Q | K | F | R | D | V | T | 44 |
| F09 | A | A | D | Y | A | M | Y | L | I | V | I | R | T | Y | S | G | G | V | S | Y | N | Q | K | F | Q | G | A | T | 45 |
| F10 | T | G | D | Y | A | M | Y | L | M | L | I | R | T | Y | F | G | G | V | T | Y | N | Q | K | F | Q | G | V | T | 46 |
| G01 | T | A | D | Y | A | M | Y | M | M | V | I | R | T | Y | S | G | D | V | S | Y | N | Q | K | F | R | D | V | K | 47 |
| G05 | A | A | E | Y | A | M | Y | M | M | L | I | R | T | Y | S | G | G | V | T | Y | N | Q | K | F | R | G | V | T | 48 |
| B07 | A | A | G | Y | A | M | Y | L | M | V | I | R | T | F | S | G | G | V | S | Y | N | Q | K | F | R | G | A | K | 49 |
| C03 | T | G | D | Y | A | M | Y | M | I | V | I | K | T | Y | S | G | D | V | T | Y | N | Q | K | F | K | D | A | T | 50 |
| F07 | T | A | D | Y | A | M | Y | L | I | V | I | Q | T | Y | F | G | E | V | T | Y | N | Q | K | F | Q | E | V | A | 51 |
| D11 | A | A | E | Y | A | M | Y | M | I | V | I | R | T | F | S | G | G | V | T | Y | N | Q | K | F | Q | E | V | K | 52 |
| F08 | A | A | E | Y | A | M | H | L | M | V | I | R | T | Y | S | G | G | V | S | Y | N | Q | K | F | Q | E | V | T | 53 |

FIGURE 22B

| Numbering Scheme | | | | | | | | | | | | CDR1 | | | | | | | | | | FR2 | | | | | CDR2 | | | | | | FR3 | | | | | | | | CDR3 | | | | | | SEQ ID NO: |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| IMGT | 24 | 25 | 26 | 27 | 28 | 29 | 30 | 31 | 32 | 33 | 34 | 35 | 36 | 37 | 38 | 39 | 40 | 41 | 43 | 44 | 52 | 56 | 57 | 58 | 66 | 67 | 68 | 69 | 77 | 78 | 94 | 95 | 103 | 105 | 106 | 107 | 108 | 109 | 110 | 111 | | | | | | |
| Kabat | L24 | L25 | L26 | 27 | 27A | 27B | 27C | 27D | 27E | 27F | 28 | 29 | 30 | 31 | 32 | L33 | L34 | L35 | L37 | L38 | L46 | L50 | L51 | L52 | L53 | L54 | L55 | L56 | L58 | L63 | L64 | L78 | L79 | 87 | 89 | 90 | 91 | 92 | 93 | 94 | 95 | 96 | 97 | | | | |
| hum231-32-15VK | K | S | S | Q | S | L | L | N | S | G | N | Q | K | N | Y | L | T | W | Q | Q | L | W | A | S | T | R | E | S | S | G | L | Q | H | Q | N | D | Y | S | Y | P | L | T | 54 |
| Design of ML39 | K | S | S | Q | S | L | L | N | S | G | N | Q | K | N | Y | L | T | W | Q | Q | L | W | A | S | T | R | E | S | S | G | L | Q | H | Q | N | D | Y | S | Y | P | L | T | 55 |
| | | | | | | | | | | X1 | | | | | | X2 | | X3 | | X4 | | | | | | | | X5 | | X6 | | X7 | | X8 | | | | X9 | | | | | |
| | | | | | | | | | | S | | | | | | S | | H | | M | | | | | | | | T | | V | | Y | | E | | | | F | | | | | |
| | | | | | | | | | | | | | | | | | | | | | | | | | | | | | | | | | | | | | | S | | | | | |
| Variant D03 | K | S | S | Q | S | L | L | N | S | G | N | Q | K | N | Y | L | S | W | Q | L | L | W | A | S | T | R | E | S | S | G | V | Q | H | Q | N | E | Y | S | Y | P | Y | T | 56 |
| D05 | K | S | S | Q | S | L | L | N | S | G | N | Q | K | N | Y | L | T | W | H | L | L | W | A | S | T | R | E | S | T | G | V | Q | Y | Q | N | D | Y | S | Y | P | Y | T | 57 |
| D07 | K | S | S | Q | S | L | L | N | S | G | N | Q | K | N | Y | L | T | W | Q | L | L | W | A | S | T | R | E | S | T | G | L | Q | H | Q | N | E | Y | S | Y | P | Y | T | 58 |
| D08 | K | S | S | Q | S | L | L | N | S | G | N | Q | K | N | Y | L | S | W | Q | L | L | W | A | S | T | R | E | S | S | G | V | Q | H | Q | N | D | Y | S | Y | P | Y | T | 59 |
| D09 | K | S | S | Q | S | L | L | N | S | S | N | Q | K | N | Y | L | T | W | Q | Q | L | W | A | S | T | R | E | S | T | G | L | Q | Y | Q | N | E | Y | S | F | P | Y | T | 60 |
| E01 | K | S | S | Q | S | L | L | N | S | G | N | Q | K | N | Y | L | S | W | Q | Q | L | W | A | S | T | R | E | S | S | G | L | Q | H | Q | N | D | Y | S | Y | P | Y | T | 61 |
| F09 | K | S | S | Q | S | L | L | N | S | S | N | Q | K | N | Y | L | T | W | Q | Q | L | W | A | S | T | R | E | S | T | G | V | Q | H | Q | N | E | Y | S | Y | P | Y | T | 62 |
| F10 | K | S | S | Q | S | L | L | N | S | G | N | Q | K | N | Y | L | S | W | Q | Q | L | W | A | S | T | R | E | S | S | G | L | Q | H | Q | N | D | Y | S | Y | P | Y | T | 63 |
| G05 | K | S | S | Q | S | L | L | N | S | S | N | Q | K | N | Y | L | T | W | Q | Q | L | W | A | S | T | R | E | S | S | G | V | Q | Y | Q | N | D | Y | S | Y | P | Y | T | 64 |
| n.a. | K | S | S | Q | S | L | L | N | S | G | N | Q | K | N | Y | L | T | W | H | Q | L | W | A | S | T | R | E | S | S | G | L | Q | H | Q | N | D | Y | S | Y | P | Y | T | 65 |
| G09 | K | S | S | Q | S | L | L | N | S | G | N | Q | K | N | Y | L | S | W | Q | Q | L | W | A | S | T | R | E | S | T | G | V | Q | H | Q | N | D | Y | S | Y | P | Y | T | 66 |
| C11 | K | S | S | Q | S | L | L | N | S | S | N | Q | K | N | Y | L | T | W | Q | Q | L | W | A | S | T | R | E | S | S | G | L | Q | H | Q | N | E | Y | S | F | P | Y | T | 67 |
| F02 | K | S | S | Q | S | L | L | N | S | S | N | Q | K | N | Y | L | T | W | Q | Q | L | W | A | S | T | R | E | S | S | G | L | Q | Y | Q | N | D | Y | S | Y | P | Y | T | 68 |
| F03 | K | S | S | Q | S | L | L | N | S | G | N | Q | K | N | Y | L | T | W | Q | Q | L | W | A | S | T | R | E | S | T | G | L | Q | Y | Q | N | D | Y | S | Y | P | Y | T | 69 |
| D07.2 | K | S | S | Q | S | L | L | N | S | G | N | Q | K | N | Y | L | T | W | Q | Q | L | W | A | S | T | R | E | S | S | G | L | Q | H | Q | N | D | Y | S | F | P | Y | T | 70 |
| F05 | K | S | S | Q | S | L | L | N | S | G | N | Q | K | N | Y | L | T | W | Q | Q | L | W | A | S | T | R | E | S | S | G | L | Q | H | Q | N | D | Y | S | F | P | Y | T | 71 |

FIGURE 23

| Antibody ID | Heavy chain variable region | SEQ ID NO: | Light chain variable region | SEQ ID NO: | Number of extra germline amino acids | Mean relative affinity vs. 231-32-15 (%) |
|---|---|---|---|---|---|---|
| pab1964 | BADD427-2616 | 249 | BADD427-2631 | 435 | 4 | 95 |
| pab1965 | BADD427-2617 | 251 | BADD427-2632 | 437 | 0 | 93 |
| pab1966 | BADD427-2619 | 254 | BADD427-2634 | 440 | 4 | 91 |
| pab1967 | BADD427-2620 | 255 | BADD427-2635 | 441 | 4 | 90 |
| pab1968 | BADD427-2621 | 259 | BADD427-2636 | 444 | 4 | 84 |
| pab1969 | BADD427-2622 | 276 | BADD427-2637 | 458 | 6 | 79 |
| pab1970 | BADD427-2623 | 277 | BADD427-2638 | 459 | 4 | 77 |
| pab1971 | BADD427-2624 | 280 | BADD427-2639 | 453 | 3 | 73 |
| pab1972 | BADD427-2625 | 284 | BADD427-2640 | 463 | 3 | 72 |
| pab1973 | BADD427-2626 | 304 | BADD427-2641 | 519 | 3 | 72 |
| pab1975 | BADD427-2622 | 276 | BADD427-2634 | 440 | 8 | 68 |
| pab1976 | BADD427-2622 | 276 | BADD427-2636 | 444 | 8 | 67 |
| pab1977 | BADD427-2622 | 276 | BADD427-2644 | 453 | 8 | 66 |
| pab1979 | BADD427-2630 | 345 | BADD427-2634 | 440 | 8 | 63 |
| pab1980 | BADD427-2630 | 345 | BADD427-2636 | 444 | 8 | 62 |
| pab1981 | BADD427-2630 | 345 | BADD427-2644 | 453 | 8 | 58 |
| pab1983 | BADD427-2616 | 249 | BADD427-2634 | 440 | 7 | 16 |

FIGURE 24A

| Antibody ID | Heavy chain variable region | SEQ ID NO: | Light chain variable region | SEQ ID NO: |
|---|---|---|---|---|
| 1 | H1916A01 | 215 | K1916A01 | 400 |
| 2 | H1916A03 | 217 | K1916A03 | 401 |
| 3 | H1916A04 | 218 | K1916A04 | 402 |
| 4 | H1916A05 | 219 | K1916A05 | 403 |
| 5 | H1916A06 | 220 | K1916A06 | 404 |
| 6 | H1916A07 | 221 | K1916A07 | 405 |
| 7 | H1916A08 | 222 | K1916A08 | 406 |
| 8 | H1916A09 | 223 | K1916A09 | 407 |
| 9 | H1916A10 | 224 | K1916A10 | 408 |
| 10 | H1916A11 | 225 | K1916A11 | 409 |
| 11 | H1916A12 | 226 | K1916A12 | 410 |
| 12 | H1916B01 | 227 | K1916B01 | 411 |
| 13 | H1916B03 | 228 | K1916B03 | 413 |
| 14 | H1916B04 | 229 | K1916B04 | 414 |
| 15 | H1916B05 | 230 | K1916B05 | 415 |
| 16 | H1916B06 | 231 | K1916B06 | 416 |
| 17 | H1916B08 | 232 | K1916B08 | 418 |
| 18 | H1916B09 | 233 | K1916B09 | 419 |
| 19 | H1916B10 | 234 | K1916B10 | 420 |
| 20 | H1916B12 | 236 | K1916B12 | 421 |
| 21 | H1916C03 | 237 | K1916C03 | 423 |
| 22 | H1916C04 | 238 | K1916C04 | 424 |
| 23 | H1916C05 | 239 | K1916C05 | 425 |
| 24 | H1916C06 | 240 | K1916C06 | 426 |
| 25 | H1916C07 | 241 | K1916C07 | 427 |
| 26 | H1916C08 | 242 | K1916C08 | 428 |
| 27 | H1916C09 | 243 | K1916C09 | 429 |
| 28 | H1916C10 | 244 | K1916C10 | 430 |
| 29 | H1916C11 | 245 | K1916C11 | 431 |
| 30 | H1916C12 | 246 | K1916C12 | 432 |
| 31 | H1916D01 | 247 | K1916D01 | 433 |
| 32 | H1916D02 | 248 | K1916D02 | 434 |
| 33 | H1916D03 | 249 | K1916D03 | 435 |
| 34 | H1916D04 | 250 | K1916D04 | 436 |
| 35 | H1916D05 | 251 | K1916D05 | 437 |
| 36 | H1916D06 | 252 | K1916D06 | 438 |
| 37 | H1916D07 | 253 | K1916D07 | 439 |
| 38 | H1916D08 | 254 | K1916D08 | 440 |
| 39 | H1916D09 | 255 | K1916D09 | 441 |
| 40 | H1916D10 | 256 | K1916D10 | 442 |

FIGURE 24B

| Antibody ID | Heavy chain variable region | SEQ ID NO: | Light chain variable region | SEQ ID NO: |
|---|---|---|---|---|
| 41 | H1916D12 | 258 | K1916D12 | 443 |
| 42 | H1916E01 | 259 | K1916E01 | 444 |
| 43 | H1916E03 | 261 | K1916E03 | 445 |
| 44 | H1916E04 | 262 | K1916E04 | 446 |
| 45 | H1916E05 | 263 | K1916E05 | 447 |
| 46 | H1916E06 | 264 | K1916E06 | 448 |
| 47 | H1916E08 | 265 | K1916E08 | 450 |
| 48 | H1916E10 | 267 | K1916E10 | 451 |
| 49 | H1916E11 | 268 | K1916E11 | 452 |
| 50 | H1916F03 | 270 | K1916F03 | 454 |
| 51 | H1916F04 | 271 | K1916F04 | 455 |
| 52 | H1916F05 | 272 | K1916F05 | 456 |
| 53 | H1916F06 | 273 | K1916F06 | 457 |
| 54 | H1916F09 | 276 | K1916F09 | 458 |
| 55 | H1916F10 | 277 | K1916F10 | 459 |
| 56 | H1916G01 | 280 | K1916G01 | 460 |
| 57 | H1916G02 | 281 | K1916G02 | 461 |
| 58 | H1916G04 | 283 | K1916G04 | 462 |
| 59 | H1916G05 | 284 | K1916G05 | 463 |
| 60 | H1916G06 | 285 | K1916G06 | 464 |
| 61 | H1917A02 | 287 | K1917A02 | 467 |
| 62 | H1917A03 | 288 | K1917A03 | 468 |
| 63 | H1917A05 | 290 | K1917A05 | 469 |
| 64 | H1917A06 | 291 | K1917A06 | 470 |
| 65 | H1917A09 | 294 | K1917A09 | 471 |
| 66 | H1917A11 | 296 | K1917A11 | 472 |
| 67 | H1917A12 | 297 | K1917A12 | 473 |
| 68 | H1917B01 | 298 | K1917B01 | 474 |
| 69 | H1917B02 | 299 | K1917B02 | 475 |
| 70 | H1917B04 | 301 | K1917B04 | 476 |
| 71 | H1917B07 | 304 | K1917B07 | 477 |
| 72 | H1917B12 | 305 | K1917B12 | 481 |
| 73 | H1917C01 | 306 | K1917C01 | 482 |
| 74 | H1917C03 | 308 | K1917C03 | 483 |
| 75 | H1917C09 | 313 | K1917C09 | 484 |
| 76 | H1917C10 | 314 | K1917C10 | 485 |
| 77 | H1917C11 | 315 | K1917C11 | 486 |
| 78 | H1917D01 | 316 | K1917D01 | 488 |
| 79 | H1917D04 | 319 | K1917D04 | 489 |
| 80 | H1917D07 | 320 | K1917D07 | 490 |

FIGURE 24C

| Antibody ID | Heavy chain variable region | SEQ ID NO: | Light chain variable region | SEQ ID NO: |
|---|---|---|---|---|
| 81 | H1917D09 | 322 | K1917D09 | 491 |
| 82 | H1917D10 | 323 | K1917D10 | 492 |
| 83 | H1917D11 | 324 | K1917D11 | 493 |
| 84 | H1917D12 | 325 | K1917D12 | 494 |
| 85 | H1917E02 | 327 | K1917E02 | 495 |
| 86 | H1917E03 | 328 | K1917E03 | 496 |
| 87 | H1917E08 | 333 | K1917E08 | 497 |
| 88 | H1917E11 | 336 | K1917E11 | 498 |
| 89 | H1917F01 | 338 | K1917F01 | 499 |
| 90 | H1917F02 | 339 | K1917F02 | 500 |
| 91 | H1917F03 | 340 | K1917F03 | 501 |
| 92 | H1917F05 | 342 | K1917F05 | 502 |
| 93 | H1917F06 | 343 | K1917F06 | 503 |
| 94 | H1917G01 | 350 | K1917G01 | 504 |
| 95 | H1917G05 | 354 | K1917G05 | 505 |
| 96 | H1917G06 | 355 | K1917G06 | 506 |
| 97 | H1917G07 | 356 | K1917G07 | 507 |
| 98 | H1917G09 | 358 | K1917G09 | 508 |
| 99 | H1917G10 | 359 | K1917G10 | 509 |
| 100 | H1917G11 | 360 | K1917G11 | 510 |
| 101 | H1917H01 | 362 | K1917H01 | 511 |
| 102 | H1917H02 | 363 | K1917H02 | 512 |
| 103 | H1917H04 | 364 | K1917H04 | 513 |
| 104 | H1917H06 | 365 | K1917H06 | 515 |
| 105 | H1917H07 | 366 | K1917H07 | 516 |
| 106 | H1917H08 | 367 | K1917H08 | 517 |
| 107 | H1917H09 | 368 | K1917H09 | 518 |

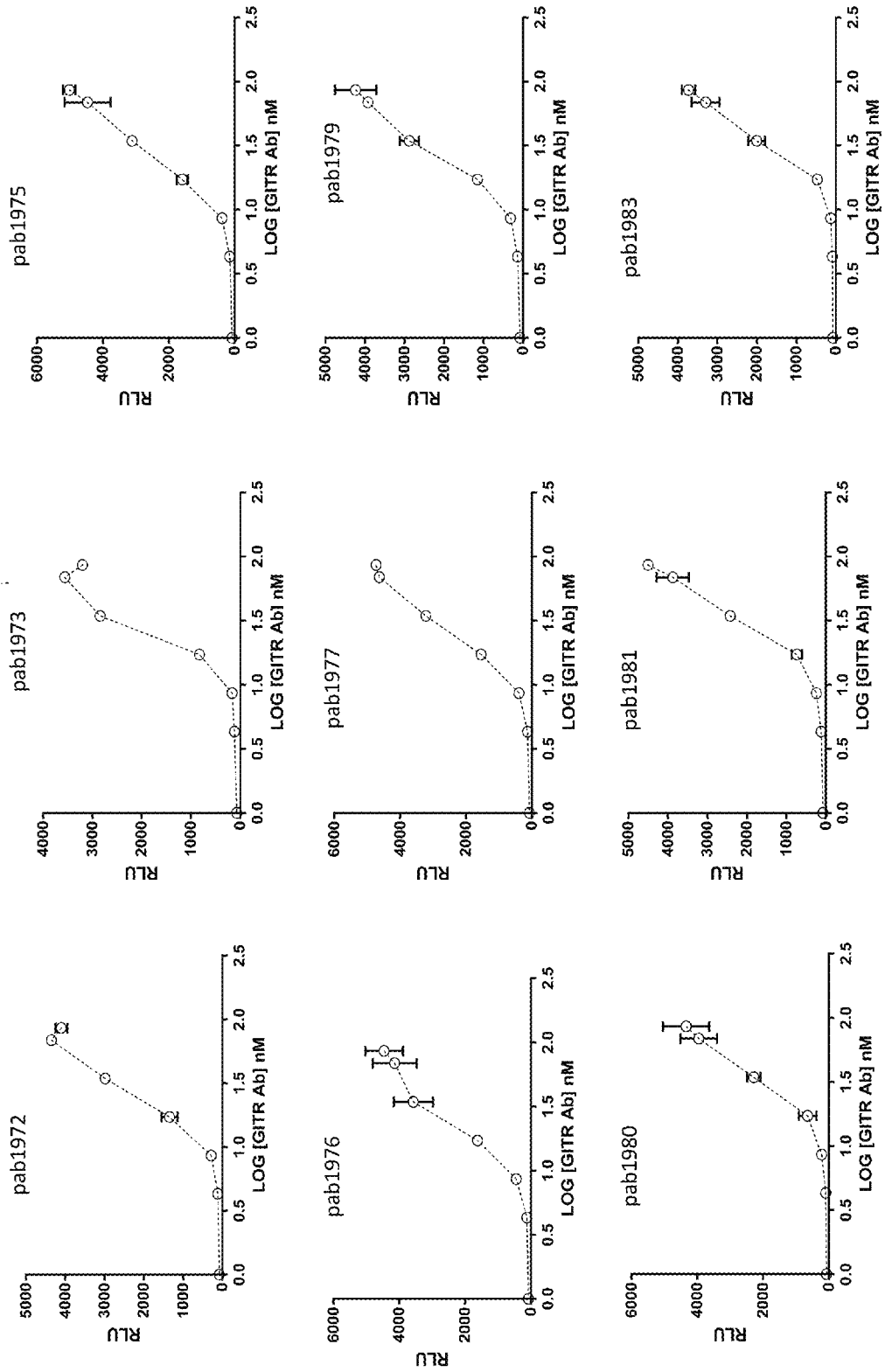

FIGURE 34A

| Mutant | construct number | Hum231#2 | pab1967 | pab1975 | pab1979 | m6C8 |
|---|---|---|---|---|---|---|
| T54A | 4526 | + | + | + | + | + |
| T55A | 4527 | + | + | + | + | + |
| R56A | 4528 | + | + | + | + | + |
| C57A | 4529 | + | + | + | + | + |
| C58A | 4530 | +/- | +/- | +/- | +/- | +/- |
| R59A | 4531 | + | + | + | + | + |
| D60A | 4532 | - | +/- | +/- | +/- | + |
| Y61A | 4533 | + | + | + | + | + |
| P62A | 4534 | + | + | + | + | + |
| G63A | 4535 | +/- | +/- | +/- | +/- | + |
| E64A | 4536 | + | + | + | + | + |
| E65A | 4537 | + | + | + | + | + |
| C66A | 4538 | + | + | + | + | + |
| C67A | 4539 | + | + | + | + | + |
| S68A | 4540 | + | + | + | + | + |
| E69A | 4541 | + | + | + | + | + |
| W70A | 4542 | + | + | + | + | + |
| D71A | 4543 | + | + | + | + | + |
| C72A | 4544 | + | + | + | + | + |
| M73A | 4545 | + | + | + | + | + |
| C74A | 4546 | | | | | |
| V75A | 4547 | + | + | + | + | + |
| Q76A | 4548 | + | + | + | + | + |
| P28A | 4595 | + | + | + | + | + |
| T29A | 4596 | + | + | + | + | + |
| G30A | 4597 | + | + | + | + | + |
| G31A | 4598 | + | + | + | + | + |
| P32A | 4599 | + | + | + | + | + |

FIGURE 35A

```
                        MARHGAMCACGTLCCLALLCAASLGQRPTGGPGCCGPGRLLLGTGKDARCCRVHPTRCCRDYPGEECCSEWDCVCVQPEFH
human GITR              MAQHGAMCAFRALCGLALLCALSLGQRPTGGPGCCGPGRLLLGTGTDARCCRVHTTRCCRDYPGEECCSEWDCMCVQPEFH  80
V1M/Q62P/S63G cyno GITR ..R.....C.CGT..C........A..................K......P.........................V....  80
V1M cyno GITR           ..R.....C.CGT..C........A..................K......P..........QS..............V....  80
                                 10        20        30        40        50        60        70        80
                                                                                        **

CGMPCCTTCQHHPCPSGQDGVQPQGKFSFGFRCVDCALGTFSRGHDGHCKPWTDCTQFGFLTVFPGNKTHMAVCVPGSPPA
human GITR              CGDPCCTTCRHHPCPPGQGVQSQGKFSFGFQEIDLASGTFSGGHEGHCKPWTDCTQFGFLTVFPGNKTHMAVCVPGSPPA   160
V1M/Q62P/S63G cyno GITR ..N.....Q......S........P.......R.V....L......R..D.............................   160
V1M cyno GITR           ..N.....Q......S........P.......R.V....L......R..D.............................   160
                                 90       100       110       120       130       140       150       160

EPPGWLTIVLLAVAACVLLLTSAQLGLHIWQLG-------KTQLLLEVPPSTEDASSCQPPEEERGERLAEEKGRLGDL*
human GITR              EPLGWLTVVLLAVAACVLLLTSAQLGLHIWQLRSQCWWPRETQLLLEVPPSTEDARSCQPPEEERGERSAEEKGRLGDL*   240
V1M/Q62P/S63G cyno GITR ..P.....I..........................G-------K...........S....................L..   233
V1M cyno GITR           ..P.....I..........................G-------K...........S....................L..   233
                                170       180       190       200       210       220       230       240 human GITR              V.                                                                               242
V1M/Q62P/S63G cyno GITR V.                                                                               235
V1M cyno GITR           .                                                                                234
```

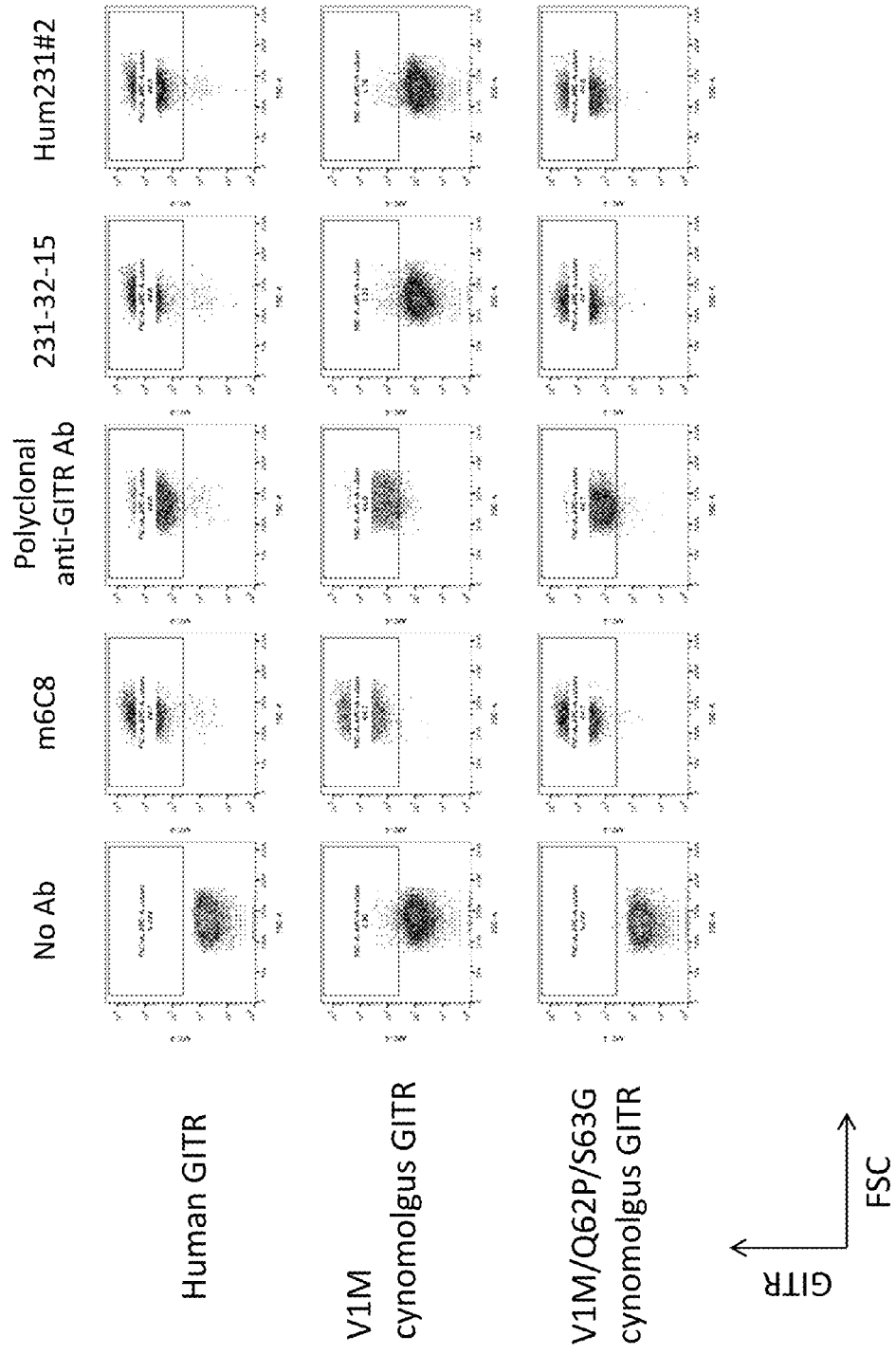

ANTI-GITR ANTIBODIES AND METHODS OF USE THEREOF

REFERENCE TO RELATED APPLICATIONS

Related applications U.S. Provisional Application No. 62/004,071, filed May 28, 2014, and U.S. Provisional Application No. 62/161,250, filed May 13, 2015, are herein incorporated by reference in their entireties.

SEQUENCE LISTING

The instant application contains a sequence listing which has been submitted electronically in ASCII format and is hereby incorporated by reference in its entirety. Said ASCII copy, created on May 28, 2015, is named 3617.0090002_SL_PatentIn_ST25.txt and is 747,129 bytes in size.

1. FIELD

The present disclosure provides antibodies that specifically bind to human glucocorticoid-induced TNFR family related receptor (GITR) and compositions comprising such antibodies. In a specific aspect, the antibodies specifically bind to human GITR and modulate GITR activity, e.g., enhance, activate or induce GITR activity, utilizing such antibodies. The present disclosure also provides methods for treating disorders, such as cancer and infectious diseases, by administering an antibody that specifically binds to human GITR and modulates GITR activity, e.g., enhances, activates or induces GITR activity.

2. BACKGROUND

Glucocorticoid-induced TNFR-related protein (GITR), a member of the TNFR superfamily, is expressed in many components of the innate and adaptive immune system and stimulates both acquired and innate immunity (Nocentini G et al., (1994) PNAS 94: 6216-6221; Hanabuchi S et al., (2006) Blood 107:3617-3623; Nocentini G & Riccardi C (2005) Eur J Immunol 35: 1016-1022; Nocentini G et al., (2007) Eur J Immunol 37:1165-1169). It is expressed in several cells and tissues, including T, B, dendritic (DC) and Natural Killer (NK) cells and is activated by its ligand, GITRL, mainly expressed on Antigen Presenting Cells (APCs), on endothelial cells, and also in tumor cells. The GITR/GITRL system participates in the development of autoimmune/inflammatory responses and potentiates response to infection and tumors. For example, treating animals with GITR-Fc fusion protein ameliorates autoimmune/inflammatory diseases while GITR triggering is effective in treating viral, bacterial, and parasitic infections, as well in boosting immune response against tumors (Nocentini G et al., (2012) Br J Pharmacol 165: 2089-99). These effects are due to several concurrent mechanisms including: co-activation of effector T-cells, inhibition of regulatory T (Treg) cells, NK-cell co-activation, activation of macrophages, modulation of dendritic cell function and regulation of the extravasation process. The membrane expression of GITR is increased following T cell activation (Hanabuchi S et al., (2006) supra; Nocentini G & Riccardi C supra). Its triggering coactivates effector T lymphocytes (McHugh R S et al., (2002) Immunity 16: 311-323; Shimizu J et al., (2002) Nat Immunol 3: 135-142; Ronchetti S et al., (2004) Eur J Immunol 34: 613-622; Tone M et al., (2003) PNAS 100: 15059-15064). GITR activation increases resistance to tumors and viral infections, is involved in autoimmune/inflammatory processes and regulates leukocyte extravasation (Nocentini G & Riccardi C (2005) supra; Cuzzocrea S et al., (2004) J Leukoc Biol 76: 933-940; Shevach E M & Stephens G L (2006) Nat Rev Immunol 6: 613-618; Cuzzocrea S et al., (2006) J Immunol 177: 631-641; Cuzzocrea S et al., (2007) FASEB J 21: 117-129).

Human GITR is expressed at very low levels in peripheral (non-activated) T cells. After T cell activation, GITR is strongly up-regulated for several days in both CD4$^+$ and CD8$^+$ cells (Kwon B et al., (1999) J Biol Chem 274: 6056-6061; Gurney A L et al., (1999) Curr Biol 9: 215-218; Ronchetti S et al., (2004) supra; Shimizu J et al., (2002) supra; Ji H B et al., (2004) supra; Ronchetti S et al., (2002) Blood 100: 350-352; Li Z et al., (2003) J Autoimmun 21: 83-92), with CD4$^+$ cells having a higher GITR expression than CD8$^+$ cells (Kober J et al., (2008) Eur J Immunol 38(10): 2678-88; Bianchini R et al., (2011) Eur J Immunol 41(8): 2269-78).

Given the role of human GITR in modulating immune responses, provided herein are antibodies that specifically bind to GITR and the use of those antibodies to modulate GITR activity.

3. SUMMARY

In one aspect, provided herein are antibodies and fragments thereof that specifically bind to GITR (e.g., human GITR). In one embodiment, an antibody or antigen-binding fragment thereof that specifically binds to GITR (e.g., human GITR) partially inhibits GITR ligand (e.g., human GITRL) from binding to GITR as assessed by a method known to one of skill in the art or described herein (see, e.g., Sections 6.2.5.2 and 6.2.5.4, infra). In a specific embodiment, the antibody or antigen-binding fragment thereof at a concentration of 1000 ng/ml inhibits less than 80% of 0.5 nM GITRL (e.g., human GITRL) from binding to GITR coupled to beads (e.g., human GITR coupled to Luminex® beads) at a concentration of 5 pg/ml/bead relative to the binding of 0.5 nM GITRL to the GITR coupled beads at a concentration of 5 pg/ml/bead in the absence of the anti-GITR antibody or antigen-binding fragment thereof in a suspension array assay. In certain embodiments, the antibody or antigen-binding fragment thereof inhibits 40% to 70%, 50% to 70%, 50% to 80%, or 40% to 80% of the GITRL (e.g., human GITRL) from binding to GITR (e.g., human GITR). In another specific embodiment, at least 20% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof in an assay: (a) coupling GITR (e.g., human GITR) to beads at a concentration of 5 pg/ml/bead; (b) incubating the GITR (e.g., human GITR) coupled beads at a concentration of 40 beads/μl with or without the antibody in a well; (c) adding labeled GITRL (e.g., labeled human GITRL) to the well to obtain a final concentration of 0.5 nM of the GITRL (e.g., human GITRL) and 20 beads/μl of the GITR coupled beads; and (d) detecting the labeled GITRL (e.g., human GITRL) bound to the GITR (e.g., human GITR) coupled beads by, e.g., a suspension array assay. In some embodiments, 20% to 60%, 20% to 50%, 30% to 60% or 30% to 50% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof.

In certain embodiments, the antibody or antigen-binding fragment thereof comprises:

(a) a heavy chain variable region (VH) complementarity determining region (CDR) 1 comprising, consisting of, or consisting essentially of the amino acid sequence of $X_1YX_2MX_3$ (SEQ ID NO: 1), wherein
$X_1$ is D, E, G or A;
$X_2$ is A, V, L, I, P, F, M or Y; and
$X_3$ is Y, G, N, Q, S, T, C, W, F or H;

(b) a VH CDR2 comprising, consisting of, or consisting essentially of the amino acid sequence of $X_1IX_2X_3X_4SGX_5X_6X_7YX_8QKFX_9X_{10}$ (SEQ ID NO: 2), wherein
$X_1$ is V, A, L, I, P, F, M or T;
$X_2$ is R, K, H, Q or A;
$X_3$ is T, G, N, Q, S, C, W, Y, V, I or P;
$X_4$ is Y, G, N, Q, S, T, C, W, F, H, or A;
$X_5$ is D, E, G or A;
$X_6$ is V, A, L, I, P, F, M or T;
$X_7$ is T, G, N, Q, S, C, W, Y, V, I, P or A;
$X_8$ is N, G, Q, S, T, C, W, Y or A;
$X_9$ is K, R, H, Q or A; and
$X_{10}$ is D, E, G or A;

(c) a VH CDR3 comprising, consisting of, or consisting essentially of the amino acid sequence of $SGTVRGX_1X_2X_3$ (SEQ ID NO: 3), wherein
$X_1$ is F, A, V, L, I, P, M, Y, W, H or S;
$X_2$ is A or D; and
$X_3$ is Y, G, N, Q, S, T, C, W, F, H or V;

(d) a light chain variable region (VL) CDR1 comprising, consisting of, or consisting essentially of the amino acid sequence of $KSSQSX_1X_2X_3X_4X_5X_6X_7KX_8YLX_9$ (SEQ ID NO: 4), wherein:
$X_1$ is L, A, V, I, P, F or M;
$X_2$ is L, A, V, I, P, F, M or S;
$X_3$ is N, G, Q, S, T, C, W, Y or A;
$X_4$ is S, G, N, Q, T, C, W, Y or A;
$X_5$ is G, N, Q, S, T, C, W, Y or A;
$X_6$ is N, G, Q, S, T, C, W, Y or A;
$X_7$ is Q, G, N, S, T, C, W, Y or A;
$X_8$ is N, G, Q, S, T, C, W, Y or A; and
$X_9$ is T, G, N, Q, S, C, W, Y, V, I or A;

(e) a VL CDR2 comprising, consisting of, or consisting essentially of the amino acid sequence of $X_1ASTRX_2X_3$ (SEQ ID NO: 5), wherein:
$X_1$ is W, G, N, Q, S, T, C, Y, F, H or A;
$X_2$ is E, D or A; and
$X_3$ is S, G, N, Q, T, C, W, Y or A; and (f) a VL CDR3 comprising, consisting of, or consisting essentially of the amino acid sequence of $QX_1X_2YX_3X_4PYT$ (SEQ ID NO: 6), wherein:
$X_1$ is N, G, Q, S, T, C, W or Y;
$X_2$ is D, E or Y; and
$X_3$ is S, G, N, Q, T, C, W, Y or A, and
$X_4$ is Y, G, N, Q, S, T, C, W, F, H, L, or A.

In other embodiments, the antibody or antigen-binding fragment thereof comprises:

(a) a heavy chain variable region (VH) CDR1 comprising, consisting of, or consisting essentially of the amino acid sequence of $X_1YX_2MX_3$ (SEQ ID NO: 7), wherein
$X_1$ is D, E or G;
$X_2$ is A or V; and
$X_3$ is Y or H;

(b) a VH CDR2 comprising, consisting of, or consisting essentially of the amino acid sequence of $X_1IX_2TX_3SGX_4X_5X_6YNQKFX_7X_8$ (SEQ ID NO: 8), wherein $X_1$ is V or L;
$X_2$ is R, K or Q;
$X_3$ is Y or F;
$X_4$ is D, E or G;
$X_5$ is V or L;
$X_6$ is T or S;
$X_7$ is K, R or Q; and
$X_8$ is D, E or G;

(c) a VH CDR3 comprising, consisting of, or consisting essentially of the amino acid sequence of SGTVRGFAY (SEQ ID NO: 9);

(d) a light chain variable region (VL) CDR1 comprising, consisting of, or consisting essentially of the amino acid sequence of $KSSQSLLNSX_1NQKNYLX_2$ (SEQ ID NO: 10), wherein
$X_1$ is G or S; and
$X_2$ is T or S;

(e) a VL CDR2 comprising, consisting of, or consisting essentially of the amino acid sequence of WASTRES (SEQ ID NO: 11); and (f) a VL CDR3 comprising, consisting of, or consisting essentially of the amino acid sequence of $QNX_1YSX_2PYT$ (SEQ ID NO: 12), wherein
$X_1$ is D or E; and
$X_2$ is Y, F or S.

In some embodiments, provided herein is an antibody or antigen-binding fragment thereof that specifically binds to GITR (e.g., human GITR), comprising:

(a) a heavy chain variable region (VH) complementarity determining region (CDR) 1 comprising, consisting of, or consisting essentially of the amino acid sequence of $X_1YX_2MX_3$ (SEQ ID NO: 1), wherein
$X_1$ is D, E, G or A;
$X_2$ is A, V, L, I, P, F, M or Y; and
$X_3$ is Y, G, N, Q, S, T, C, W, F or H;

(b) a VH CDR2 comprising, consisting of, or consisting essentially of the amino acid sequence of $X_1IX_2X_3X_4SGX_5X_6X_7YX_8QKFX_9X_{10}$ (SEQ ID NO: 2), wherein
$X_1$ is V, A, L, I, P, F, M or T;
$X_2$ is R, K, H, Q or A;
$X_3$ is T, G, N, Q, S, C, W, Y, V, I or P;
$X_4$ is Y, G, N, Q, S, T, C, W, F, H, or A;
$X_5$ is D, E, G or A;
$X_6$ is V, A, L, I, P, F, M or T;
$X_7$ is T, G, N, Q, S, C, W, Y, V, I, P or A;
$X_8$ is N, G, Q, S, T, C, W, Y or A;
$X_9$ is K, R, H, Q or A; and
$X_{10}$ is D, E, G or A;

(c) a VH CDR3 comprising, consisting of, or consisting essentially of the amino acid sequence of $SGTVRGX_1X_2X_3$ (SEQ ID NO: 3), wherein
$X_1$ is F, A, V, L, I, P, M, Y, W, H or S;
$X_2$ is A, or D; and
$X_3$ is Y, G, N, Q, S, T, C, W, F, H or V;

(d) a light chain variable region (VL) CDR1 comprising, consisting of, or consisting essentially of the amino acid sequence of $KSSQSX_1X_2X_3X_4X_5X_6X_7KX_8YLX_9$ (SEQ ID NO: 4), wherein:
$X_1$ is L, A, V, I, P, F or M;
$X_2$ is L, A, V, I, P, F, M or S;
$X_3$ is N, G, Q, S, T, C, W, Y or A;
$X_4$ is S, G, N, Q, T, C, W, Y or A;
$X_5$ is G, N, Q, S, T, C, W, Y or A;
$X_6$ is N, G, Q, S, T, C, W, Y or A;
$X_7$ is Q, G, N, S, T, C, W, Y or A;
$X_8$ is N, G, Q, S, T, C, W, Y or A; and
$X_9$ is T, G, N, Q, S, C, W, Y, V, I or A;

(e) a VL CDR2 comprising, consisting of, or consisting essentially of the amino acid sequence of $X_1ASTRX_2X_3$ (SEQ ID NO: 5), wherein:
$X_1$ is W, G, N, Q, S, T, C, Y, F, H or A;
$X_2$ is E, D or A; and
$X_3$ is S, G, N, Q, T, C, W, Y or A; and (f) a VL CDR3 comprising, consisting of, or consisting essentially of the amino acid sequence of $QX_1X_2YX_3X_4PYT$ (SEQ ID NO: 6), wherein:
$X_1$ is N, G, Q, S, T, C, W or Y;
$X_2$ is D, E or Y; and
$X_3$ is S, G, N, Q, T, C, W, Y or A, and
$X_4$ is Y, G, N, Q, S, T, C, W, F, H, L, or A. In certain embodiments, the antibody or antigen-binding fragment thereof comprises a VH CDR1 comprising, consisting of, or consisting essentially of an amino acid sequence selected from the group consisting of SEQ ID NO: 13, 19-23, and 117-119. In certain embodiments, the antibody or antigen-binding fragment thereof comprises a VH CDR1 comprising, consisting of, or consisting essentially of an amino acid sequence selected from the group consisting of SEQ ID NO: 35 and SEQ ID NO:116. In some embodiments, the antibody or antigen-binding fragment thereof comprises a VH CDR2 comprising, consisting of, or consisting essentially of an amino acid sequence selected from the group consisting of SEQ ID NO: 14, 24-33, and 120-188. In some embodiments, the antibody or antigen-binding fragment thereof comprises a VH CDR2 comprising, consisting of, or consisting essentially of an amino acid sequence selected from the group consisting of SEQ ID NO: 114, 115, and 194. In certain embodiments, the antibody or antigen-binding fragment thereof comprises a VH CDR3 comprising, consisting of, or consisting essentially of an amino acid sequence selected from the group consisting of SEQ ID NO: 15, 34 and 189. In some embodiments, the antibody or antigen-binding fragment thereof comprises a VL CDR1 comprising, consisting of, or consisting essentially of an amino acid sequence selected from the group consisting of SEQ ID NO: 16 and 101-104. In certain embodiments, the antibody or antigen-binding fragment thereof comprises a VL CDR2 comprising, consisting of, or consisting essentially of an amino acid sequence selected from the group consisting of SEQ ID NO: 17 and 105. In some embodiments, the antibody or antigen-binding fragment thereof comprises a VL CDR3 comprising, consisting of, or consisting essentially of an amino acid sequence selected from the group consisting of SEQ ID NO: 18, 106-109, 192, and 193. In specific embodiments, the antibody or antigen-binding fragment thereof comprises the amino acid sequence of the VH CDR1, VH CDR2, and VH CDR3 of an antibody in Table 2. In specific embodiments, the antibody or antigen-binding fragment thereof comprises the amino acid sequences of the VH CDR1, VH CDR2, and VH CDR3 of an antibody in Table 6. In another specific embodiment, the antibody or antigen-binding fragment thereof comprises the amino acid sequence of the VL CDR1, VL CDR2, and VL CDR3 of an antibody in Table 1. In another specific embodiment, the antibody or antigen-binding fragment thereof comprises the amino acid sequences of the VL CDR1, VL CDR2, and VL CDR3 of an antibody in Table 5. In some embodiments, the antibody or antigen-binding fragment thereof partially inhibits GITRL (e.g., human GITRL) from binding to GITR (e.g., human GITR) as assessed by a method known to one of skill in the art or described herein (see, e.g., Sections 6.2.5.2 and 6.2.5.4, infra). In certain embodiments, the antibody or antigen-binding fragment thereof at a concentration of 1000 ng/ml inhibits less than 80% of 0.5 nM GITRL (e.g., human GITRL) from binding to GITR coupled to beads (e.g., human GITR coupled to Luminex® beads) at a concentration of 5 pg/ml/bead relative to the binding of 0.5 nM GITRL to the GITR coupled beads at a concentration of 5 pg/ml/bead in the absence of the anti-GITR antibody or antigen-binding fragment thereof in a suspension array assay. In certain embodiments, the antibody or antigen-binding fragment thereof inhibits 40% to 70%, 50% to 70%, 50% to 80%, or 40% to 80% of the GITRL (e.g., human GITRL) from binding to GITR (e.g., human GITR). In specific embodiments, at least 20% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof in an assay comprising the following steps: (a) coupling GITR (e.g., human GITR) to beads at a concentration of 5 pg/ml/bead; (b) incubating the GITR (e.g., human GITR) coupled beads at a concentration of 40 beads/µl with or without the antibody in a well; (c) adding labeled GITRL (e.g., labeled human GITRL) to the well to obtain a final concentration of 0.5 nM of the GITRL (e.g., human GITRL) 20 beads/µl of the GITR coupled beads; and (d) detecting the labeled GITRL (e.g., human GITRL) bound to the GITR (e.g., human GITR) coupled beads by, e.g., a suspension array assay. In some embodiments, 20% to 60%, 20% to 50%, 30% to 60% or 30% to 50% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof.

In another embodiment, provided herein is an antibody or antigen-binding fragment thereof that specifically binds to GITR (e.g., human GITR), comprising:

(a) a heavy chain variable region (VH) CDR1 comprising, consisting of, or consisting essentially of the amino acid sequence of $X_1YX_2MX_3$ (SEQ ID NO: 7), wherein
$X_1$ is D, E or G;
$X_2$ is A or V; and
$X_3$ is Y or H;

(b) a VH CDR2 comprising, consisting of, or consisting essentially of the amino acid sequence of $X_1IX_2TX_3SGX_4X_5X_6YNQKFX_7X_8$ (SEQ ID NO: 8), wherein
$X_1$ is V or L;
$X_2$ is R, K or Q;
$X_3$ is Y or F;
$X_4$ is D, E or G;
$X_5$ is V or L;
$X_6$ is T or S;
$X_7$ is K, R or Q; and
$X_8$ is D, E or G;

(c) a VH CDR3 comprising, consisting of, or consisting essentially of the amino acid sequence of SGTVRGFAY (SEQ ID NO: 9);

(d) a light chain variable region (VL) CDR1 comprising, consisting of, or consisting essentially of the amino acid sequence of $KSSQSLLNSX_1NQKNYLX_2$ (SEQ ID NO: 10), wherein
$X_1$ is G or S; and
$X_2$ is T or S;

(e) a VL CDR2 comprising, consisting of, or consisting essentially of the amino acid sequence of WASTRES (SEQ ID NO: 11); and (f) a VL CDR3 comprising, consisting of, or consisting essentially of the amino acid sequence of QNX$_1$YSX$_2$PYT (SEQ ID NO: 12), wherein X$_1$ is D or E; and X$_2$ is Y, F or S.

In certain embodiments, the antibody or antigen-binding fragment thereof comprises a VH CDR1 comprising, consisting of, or consisting essentially of an amino acid sequence selected from the group consisting of SEQ ID NO: 13, 19-23, and 117-119. In certain embodiments, the antibody or antigen-binding fragment thereof comprises a VH CDR1 comprising, consisting of, or consisting essentially of an amino acid sequence selected from the group consisting of 35 and 116. In some embodiments, the antibody or antigen-binding fragment thereof comprises a VH CDR2 comprising, consisting of, or consisting essentially of an amino acid sequence selected from the group consisting of SEQ ID NO: 14, 24-33, and 120-188. In some embodiments, the antibody or antigen-binding fragment thereof comprises a VH CDR2 comprising, consisting of, or consisting essentially of an amino acid sequence selected from the group consisting of SEQ ID NO: 114, 115, and 194. In certain embodiments, the antibody or antigen-binding fragment thereof comprises a VH CDR3 comprising, consisting of, or consisting essentially of an amino acid sequence selected from the group consisting of SEQ ID NO: 15, 34 and 189. In some embodiments, the antibody or antigen-binding fragment thereof comprises a VL CDR1 comprising, consisting of, or consisting essentially of an amino acid sequence selected from the group consisting of SEQ ID NO: 16, and 101-104. In certain embodiments, the antibody or antigen-binding fragment thereof comprises a VL CDR2 comprising, consisting of, or consisting essentially of an amino acid sequence selected from the group consisting of SEQ ID NO: 17 and 105. In some embodiments, the antibody or antigen-binding fragment thereof comprises a VL CDR3 comprising, consisting of, or consisting essentially of an amino acid sequence selected from the group consisting of SEQ ID NO: 18, 106-109, 192, and 193. In specific embodiments, the antibody or antigen-binding fragment thereof comprises the amino acid sequence of the VH CDR1, VH CDR2, and VH CDR3 of an antibody in Table 2. In another specific embodiment, the antibody or antigen-binding fragment thereof comprises the amino acid sequence of the VL CDR1, VL CDR2, and VL CDR3 of an antibody in Table 1. In some embodiments, the antibody or antigen-binding fragment thereof does not prevent GITRL (e.g., human GITRL) from binding to GITR (e.g., human GITR) as assessed by a method known to one of skill in the art or described herein (see, e.g., Sections 6.2.5.2 and 6.2.5.4, infra). In certain embodiments, the antibody or antigen-binding fragment thereof at a concentration of 1000 ng/ml inhibits less than 80% of 0.5 nM GITRL (e.g., human GITRL) from binding to GITR coupled to beads (e.g., human GITR coupled to Luminex® beads) at a concentration of 5 pg/ml/bead relative to the binding of 0.5 nM GITRL to the GITR coupled beads at a concentration of 5 pg/ml/bead in the absence of the anti-GITR antibody or antigen-binding fragment thereof in a suspension array assay. In certain embodiments, the antibody or antigen-binding fragment thereof inhibits 40% to 70%, 50% to 70%, 50% to 80%, or 40% to 80% of the GITRL (e.g., human GITRL) from binding to GITR (e.g., human GITR). In specific embodiments, at least 20% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof in an assay comprising the following steps: (a) coupling GITR (e.g., human GITR) to beads at a concentration of 5 pg/ml/bead; (b) incubating the GITR (e.g., human GITR) coupled beads at a concentration of 40 beads/µl with or without the antibody in a well; (c) adding labeled GITRL (e.g., labeled human GITRL) to the well to obtain a final concentration of 0.5 nM of the GITRL (e.g., human GITRL) and 20 beads/µl of the GITR coupled beads; and (d) detecting the labeled GITRL (e.g., human GITRL) bound to the GITR (e.g., human GITR) coupled beads by, e.g., a suspension array assay. In some embodiments, 20% to 60%, 20% to 50%, 30% to 60% or 30% to 50% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof In a specific embodiment, provided herein is an antibody or fragment thereof that specifically binds to human GITR, comprising: (a) a heavy chain variable region (VH) CDR1 comprising the amino acid sequence of DYAMY (SEQ ID NO: 13); (b) a VH CDR2 comprising the amino acid sequence of VIRTYSGDVTYNQKFKD (SEQ ID NO: 14); (c) a VH CDR3 comprising the amino acid sequence of SGTVRGFAY (SEQ ID NO: 15); (d) a light chain variable region (VL) CDR1 comprising the amino acid sequence of KSSQSLLNSGNQKNYLT (SEQ ID NO: 16); (e) a VL CDR2 comprising the amino acid sequence of WASTRES (SEQ ID NO: 17); and (f) a VL CDR3 comprising the amino acid sequence of QNDYSYPYT (SEQ ID NO: 18). In another embodiment, provided herein is an antibody or fragment thereof that specifically binds to human GITR, comprising the VL CDR1, VL CDR2, VL CDR3, VH CDR1, VH CDR2, and VH CDR 3 of an antibody 22 in Table 1 and Table 2. In some embodiments, the antibody or antigen-binding fragment thereof partially inhibits GITRL (e.g., human GITRL) from binding to GITR (e.g., human GITR) as assessed by a method known to one of skill in the art or described herein (see, e.g., Sections 6.2.5.2 and 6.2.5.4, infra). In certain embodiments, the antibody or antigen-binding fragment thereof at a concentration of 1000 ng/ml inhibits less than 80% of GITR coupled to beads (e.g., human GITR coupled to Luminex® beads) at a concentration of 5 pg/ml/bead relative to the binding of 0.5 nM GITRL (e.g., human GITRL) to the GITR coupled beads (e.g., human GITR coupled to Luminex® beads) at a concentration of 5 pg/ml/bead in the absence of the anti-GITR antibody or antigen-binding fragment thereof in a suspension array assay. In some embodiments, the antibody or antigen-binding fragment thereof inhibits 50% to 70% of human GITRL binding to human GITR. In specific embodiments, at least 20% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof in an assay comprising the following steps: (a) coupling GITR (e.g., human GITR) to beads at a concentration of 5 pg/ml/bead; (b) incubating the GITR (e.g., human GITR) coupled beads at a concentration of 40 beads/µl with or without the antibody in a well; (c) adding labeled GITRL (e.g., labeled human GITRL) to the well to obtain a final concentration of 0.5 nM of the GITRL (e.g., human GITRL) and 20 beads/µl of the GITR coupled beads; and (d) detecting the labeled GITRL (e.g., human GITRL) bound to the GITR (e.g., human GITR) coupled beads by, e.g., a suspension array assay. In some embodiments, 20% to 60%, 20% to 50%, 30% to 60% or 30% to 50% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof. In some embodiments, 30% to 50% of the amount of human GITRL that binds to human GITR in the absence of the antibody or antigen-binding fragment thereof binds to human GITR in the presence of the antibody or antigen-binding fragment thereof. In certain embodiments, the antibody or antigen-binding fragment thereof is agonistic.

In certain embodiments, an antibody or fragment thereof provided herein, which specifically binds to GITR (e.g., human GITR), comprises a heavy chain variable region sequence comprising one, two, three or four of the framework regions of the heavy chain variable region sequence of SEQ ID NO: 203. In some embodiments, an antibody or fragment thereof provided herein, which specifically binds to GITR (e.g., human GITR), comprises one, two, three or four framework regions of a heavy chain variable region sequence which is at least 75%, 80%, 85%, 90%, 95% or 100% identical to one, two, three or four of the framework regions of a heavy chain variable region sequence selected from the group consisting of SEQ ID NO: 201, SEQ ID NO: 206, and SEQ ID NOs: 215 to 389. In another embodiment, an antibody or fragment thereof provided herein, which specifically binds to GITR (e.g., human GITR), comprises a heavy chain variable region having human derived framework regions. In another embodiment, an antibody or antigen-binding fragment thereof provided herein, which specifically binds to GITR (e.g., human GITR), comprises a heavy chain variable framework region that is or is derived from an amino acid sequence encoded by a human gene, wherein the amino acid sequence is selected from the group consisting of IGHV1-2*02 (SEQ ID NO: 601), IGHV1-3*01 (SEQ ID NO: 602), IGHV1-46*01 (SEQ ID NO: 603), IGHV1-18*01 (SEQ ID NO: 604), IGHV1-69*01 (SEQ ID NO: 605), and IGHV7-4-1*02 (SEQ ID NO: 606). In specific embodiments, the heavy chain variable framework region that is derived from said amino acid sequence consists of said amino acid sequence with up to 10 amino acid substitutions, deletions, and/or insertions, preferably up to 10 amino acid substitutions. In a particular embodiment, the heavy chain variable framework region that is derived from said amino acid sequence consists of said amino acid sequence with 1, 2, 3, 4, 5, 6, 7, 8, 9 or 10 amino acid residues being substituted for an amino acid found in an analogous position in a corresponding non-human heavy chain variable framework region. In a specific embodiment, an antibody or fragment thereof provided herein, which specifically binds to GITR (e.g., human GITR), comprises a heavy chain variable framework region that is derived from amino acid sequence SEQ ID NO: 601, wherein at least one, two, three, four, or five (in certain embodiments up to 10) amino acids of amino acid sequence SEQ ID NO: 601 is substituted with an amino acid found in an analogous position in a corresponding non-human heavy chain variable framework region. In certain embodiments, the amino acid substitution is at an amino acid position selected from the group consisting of 24, 48, 67, 71, 73, and 94, wherein the amino acid position of each group member is indicated according to the Kabat numbering. In specific embodiments, the amino acid substitution is selected from the group consisting of 24G, 48I, 67A, 71V, 73K, and 94K, wherein the amino acid position of each group member is indicated according to the Kabat numbering In another embodiment, provided herein is an antibody or fragment thereof that specifically binds to GITR (e.g., human GITR) comprising a heavy chain variable region sequence comprising an amino acid sequence selected from the group consisting of SEQ ID NO: 201, 206, and SEQ ID NOS: 215 to 389. In a specific embodiment, provided herein is an antibody or fragment thereof that specifically binds to GITR (e.g., human GITR) comprising a heavy chain variable region sequence comprising the amino acid sequence of SEQ ID NO: 203. In another specific embodiment, provided herein is an antibody or fragment thereof that specifically binds to GITR (e.g., human GITR) comprising a heavy chain variable region sequence comprising the amino acid sequence of SEQ ID NO: 206.

In another embodiment, provided herein is an antibody or fragment thereof that specifically binds to GITR (e.g., human GITR) comprising a heavy chain sequence comprising an amino acid sequence selected from the group consisting of SEQ ID NOs: 553, 554 and 567 to 570. In another embodiment, provided herein is an antibody or fragment thereof that specifically binds to GITR (e.g., human GITR) comprising a heavy chain sequence comprising an amino acid sequence selected from the group consisting of SEQ ID NOs: 581 and 582.

In another embodiment, an antibody or fragment thereof provided herein, which specifically binds to GITR (e.g., human GITR), comprises a light chain variable region sequence comprising one, two, three or four framework regions of the light chain variable region sequence of SEQ ID NO: 204 or SEQ ID NO: 205. In another embodiment, an antibody or fragment thereof provided herein, which specifically binds to GITR (e.g., human GITR), comprises one, two, three or four framework regions of a light chain variable region sequence which is at least 75%, 80%, 85%, 90%, 95%, or 100% identical to one, two, three or four of the framework regions of a light chain variable region sequence selected from the group consisting of SEQ ID NO: 202, SEQ ID NO: 207, SEQ ID NO: 208, and SEQ ID NOs: 400-518. In another embodiment, an antibody or fragment thereof provided herein, which specifically binds to GITR (e.g., human GITR), comprises one, two, three or four framework regions of a light chain variable region sequence which is at least 75%, 80%, 85%, 90%, 95%, or 100% identical to one, two, three or four of the framework regions of the light chain variable region sequence of SEQ ID NO: 519. In another embodiment, an antibody or fragment thereof provided herein, which specifically binds to GITR (e.g., human GITR), comprises a light chain variable sequence having human derived framework regions. In another embodiment, an antibody or fragment thereof provided herein, which specifically binds to GITR (e.g., human GITR), comprises a light chain variable framework region that is or is derived from an amino acid sequence encoded by a human gene, wherein the amino acid sequence is selected from the group consisting of IGKV4-1*01 (SEQ ID NO: 607) and IGKV3-7*02 (SEQ ID NO: 608). In specific embodiments, the light chain variable framework region that is derived from said amino acid sequence consists of said amino acid sequence but for the presence of up to 10 amino acid substitutions, deletions, and/or insertions, preferably up to 10 amino acid substitutions. In a particular embodiment, the light chain variable framework region that is derived from said amino acid sequence consists of said amino acid sequence with 1, 2, 3, 4, 5, 6, 7, 8, 9 or 10 amino acid residues being substituted for an amino acid found in an analogous position in a corresponding non-human light chain variable framework region. In another embodiment, an antibody or fragment thereof provided herein, which specifically binds to GITR (e.g., human GITR), comprises a light chain variable framework region that is or is derived from amino acid sequence SEQ ID NO: 607 or SEQ ID NO: 608 wherein at least one, two, three, four, or five (in certain embodiments up to 10) amino acids of amino acid sequence SEQ ID NO: 607 or SEQ ID NO: 608 is substituted with an amino acid found in an analogous position in a corresponding non-human light chain variable framework region. In certain embodiments, the amino acid substitution is at amino acid position 87, wherein the amino acid position is indicated according to the Kabat numbering. In specific embodiments, the amino acid substitution is an amino acid substitution of 87H, wherein the amino acid position is indicated according to the Kabat numbering.

In another embodiment, provided herein is an antibody or fragment thereof that specifically binds to GITR (e.g., human GITR) comprising a light chain variable region sequence comprising an amino acid sequence selected from the group consisting of SEQ ID NO: 202, SEQ ID NO: 207, SEQ ID NO: 208 and SEQ ID NOs: 400 to 518. In another embodiment, provided herein is an antibody or fragment thereof that specifically binds to GITR (e.g., human GITR) comprising a light chain variable region sequence comprising the amino acid sequence of SEQ ID NO: 519. In a specific embodiment, provided herein is an antibody or fragment thereof that specifically binds to GITR (e.g., human GITR) comprising a light chain variable region sequence comprising the amino acid sequence of SEQ ID NO: 204 or SEQ ID NO: 205. In another specific embodiment, provided herein is an antibody or fragment thereof that specifically binds to GITR (e.g., human GITR) comprising a light chain variable region sequence comprising the amino acid sequence of SEQ ID NO: 207. In another specific embodiment, provided herein is an antibody or fragment thereof that specifically binds to GITR (e.g., human GITR) comprising a light chain variable region sequence comprising the amino acid sequence of SEQ ID NO: 208.

In another embodiment, provided herein is an antibody or fragment thereof that specifically binds to GITR (e.g., human GITR) comprising a light chain sequence comprising an amino acid sequence selected from the group consisting of SEQ ID NOs: 555, 556 and 571 to 576.

In another embodiment, provided herein is an antibody or fragment thereof that specifically binds to GITR (e.g., human GITR) comprising a heavy chain variable region and a light chain variable region comprising the amino acid sequences of an antibody in the table of FIG. 23 or any one of FIGS. 24A-24C. In another embodiment, provided herein is an antibody or fragment thereof that specifically binds to GITR (e.g., human GITR) comprising a heavy chain variable region and a light chain variable region comprising the amino acid sequences of an antibody in Table 17. In an specific embodiment, provided herein is an antibody or fragment thereof that specifically binds to GITR (e.g., human GITR) comprising (a) a heavy chain variable region comprising the amino acid sequence of SEQ ID NO: 206; and (b) a light chain variable region comprising the amino acid sequence of SEQ ID NO: 207. In another specific embodiment, provided herein is an antibody or fragment thereof that specifically binds to GITR (e.g., human GITR) comprising (a) a heavy chain variable region comprising the amino acid sequence of SEQ ID NO: 206; and (b) a light chain variable region comprising the amino acid sequence of SEQ ID NO: 208.

In a specific embodiment, provided herein is an antibody or fragment thereof that specifically binds to GITR (e.g., human GITR) comprising a heavy chain variable region (VH) comprising a VH CDR1, a VH CDR2, a VH CDR3 and framework regions derived from a human immunoglobulin, wherein VH CDR1 comprises, consists of, or consists essentially of the amino acid sequence of DYAMY (SEQ ID NO: 13), VH CDR2 comprises, consists of, or consists essentially of the amino acid sequence of VIRTYS-GDVTYNQKFKD (SEQ ID NO: 14) and VH CDR3 comprises, consists of, or consists essentially of the amino acid sequence of SGTVRGFAY (SEQ ID NO: 15). In another embodiment, provided herein is an antibody or fragment thereof that specifically binds to GITR (e.g., human GITR) comprising a light chain variable region (VL) comprising a VL CDR1, a VL CDR2, a VL CDR3 and framework regions derived from a human immunoglobulin, wherein VL CDR1 comprises, consists of, or consists essentially of the amino acid sequence of KSSQSLLNSGNQKNYLT (SEQ ID NO: 16), VL CDR2 comprises, consists of, or consists essentially of the amino acid sequence of WASTRES (SEQ ID NO: 17) and VL CDR3 comprises, consists of, or consists essentially of the amino acid sequence of QNDYSYPYT (SEQ ID NO: 18). In another embodiment, provided herein is an antibody or fragment thereof that specifically binds to GITR (e.g., human GITR) comprising a heavy chain variable region (VH) comprising an amino acid sequence selected from the group consisting of SEQ ID NO: 201, 203, 206 and 215-389. In another embodiment, provided herein is an antibody or fragment thereof that specifically binds to GITR (e.g., human GITR) comprising a light chain variable region (VL) comprising an amino acid sequence selected from the group consisting of SEQ ID NO: 202, 204, 205, 207, 208 and 400-518. In another embodiment, provided herein is an antibody or fragment thereof that specifically binds to GITR (e.g., human GITR) comprising a light chain variable region (VL) comprising the amino acid sequence of SEQ ID NO: 519. In some embodiments, the antibody or antigen-binding fragment thereof partially inhibits GITRL (e.g., human GITRL) from binding to GITR (e.g., human GITR) as assessed by a method known to one of skill in the art or described herein (see, e.g., Sections 6.2.5.2 and 6.2.5.4, infra). In certain embodiments, the antibody or antigen-binding fragment thereof at a concentration of 1000 ng/ml inhibits less than 80% of 0.5 nM GITRL (e.g., human GITRL) from binding to GITR coupled to beads (e.g., human GITR coupled to Luminex® beads) at a concentration of 5 pg/ml/bead relative to the binding of 0.5 nM GITRL to the GITR coupled beads at a concentration of 5 pg/ml/bead in the absence of the anti-GITR antibody or antigen-binding fragment thereof in a suspension array assay. In specific embodiments, at least 20% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof in an assay comprising the following steps: (a) coupling GITR (e.g., human GITR) to beads at a concentration of 5 pg/ml/bead; (b) incubating the GITR (e.g., human GITR) coupled beads at a concentration of 40 beads/µl with or without the antibody in a well; (c) adding labeled GITRL (e.g., labeled human GITRL) to the well to obtain a final concentration of 0.5 nM of the GITRL (e.g., human GITRL) and 20 beads/µl of the GITR coupled beads; and (d) detecting the labeled GITRL (e.g., human GITRL) bound to the GITR (e.g., human GITR) coupled beads by, e.g., a suspension array assay. In some embodiments, 20% to 60%, 20% to 50%, 30% to 60% or 30% to 50% of the amount of GITRL (e.g., human GITRL) that binds to GITR (e.g., human GITR) in the absence of the antibody or antigen-binding fragment thereof binds to GITR (e.g., human GITR) in the presence of the antibody or antigen-binding fragment thereof.

In a specific embodiment, provided herein is an antibody or fragment thereof that specifically binds to GITR (e.g., human GITR) comprising a heavy chain variable region (VH) and a light chain variable region (VL), wherein the VH and VL comprise the amino acid sequence of an antibody in FIG. 23 or any one of FIGS. 24A-24C. In a specific embodiment, provided herein is an antibody or fragment thereof that specifically binds to GITR (e.g., human GITR) comprising a heavy chain variable region (VH) and a light chain variable region (VL), wherein the VH and VL comprise the amino acid sequence of an antibody in Table 17.

In certain embodiments, an antibody provided herein, which specifically binds to GITR (e.g., human GITR), comprises heavy and/or light chain constant regions. In some embodiments, the heavy chain constant region is selected from the group of human immunoglobulins consisting of $IgG_1$, $IgG_2$, $IgG_3$, $IgG_4$, $IgA_1$, and $IgA_2$. In certain embodiments, the light chain constant region is selected from the group of human immunoglobulins consisting of IgGκ and IgGλ. In a specific embodiment, the $IgG_1$ is non-fucosylated $IgG_1$. In another specific embodiment, the antibody is an $IgG_1$ which comprises a N297A or N297Q mutation. In another specific embodiment, the antibody is an $IgG_4$ which comprises a S228P mutation. In another specific embodiment, the antibody is an IgG2 which comprises a C127S mutation. In certain embodiments, an antibody provided herein, which specifically binds to GITR (e.g., human GITR), comprises a heavy chain constant region comprising an amino acid sequence selected from the group consisting of SEQ ID NO: 557-562. In certain embodiments, an antibody provided herein, which specifically binds to GITR (e.g., human GITR), comprises a heavy chain constant region comprising an amino acid sequence selected from the group consisting of SEQ ID NO: 583 and 584. In another specific embodiment, an antibody provided herein, which specifically binds to GITR (e.g., human GITR), comprises a heavy chain constant region comprising an amino acid sequence selected from the group consisting of SEQ ID NOs: 557-560 with an amino acid substitution of N to A or Q at amino acid position 180. In certain embodiments, an antibody provided herein, which specifically binds to GITR (e.g., human GITR), comprises a light chain constant region comprising an amino acid sequence selected from the group consisting of SEQ ID NO: 588-591. In certain embodiments, an antibody provided herein, which specifically binds to GITR (e.g., human GITR), comprises a light chain constant region comprising an amino acid sequence selected from the group consisting of SEQ ID NO: 563-566.

In a specific embodiment, an antibody provided herein, which specifically binds to GITR (e.g., human GITR), comprises (a) a heavy chain comprising an amino acid sequence selected from the group consisting of SEQ ID NO: 553, 554, and 567 to 570; and (b) a light chain comprising an amino acid sequence selected from the group consisting of SEQ ID NO: 555, 556, and 571 to 576. In another specific embodiment, an antibody provided herein, which specifically binds to GITR (e.g., human GITR), comprises (a) a heavy chain comprising the amino acid sequence of SEQ ID NO: 553; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 554; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 581; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 582; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 553; and (b) a light chain comprising the amino acid sequence of SEQ ID NO: 555. In another specific embodiment, an antibody provided herein, which specifically binds to GITR (e.g., human GITR), comprises (a) a heavy chain comprising the amino acid sequence of SEQ ID NO: 554; and (b) a light chain comprising the amino acid sequence of SEQ ID NO: 555. In another specific embodiment, an antibody provided herein, which specifically binds to GITR (e.g., human GITR), comprises (a) a heavy chain comprising the amino acid sequence of SEQ ID NO: 567; and (b) a light chain comprising the amino acid sequence of SEQ ID NO: 573. In another specific embodiment, an antibody provided herein, which specifically binds to GITR (e.g., human GITR), comprises (a) a heavy chain comprising the amino acid sequence of SEQ ID NO: 567; and (b) a light chain comprising the amino acid sequence of SEQ ID NO: 576. In another specific embodiment, an antibody provided herein, which specifically binds to GITR (e.g., human GITR), comprises (a) a heavy chain comprising the amino acid sequence of SEQ ID NO: 554; and (b) a light chain comprising the amino acid sequence of SEQ ID NO: 576. In another specific embodiment, an antibody provided herein, which specifically binds to GITR (e.g., human GITR), comprises (a) a heavy chain comprising the amino acid sequence of SEQ ID NO: 581; and (b) a light chain comprising the amino acid sequence of SEQ ID NO: 576. In another specific embodiment, an antibody provided herein, which specifically binds to GITR (e.g., human GITR), comprises (a) a heavy chain comprising the amino acid sequence of SEQ ID NO: 582; and (b) a light chain comprising the amino acid sequence of SEQ ID NO: 576.

In another specific embodiment, an antibody provided herein, which specifically binds to GITR (e.g., human GITR), comprises (a) a heavy chain comprising the amino acid sequence of SEQ ID NO: 553 with an amino acid substitution of N to A or Q at amino acid position 298; and (b) a light chain comprising an amino acid sequence selected from the group consisting of SEQ ID NO: 555, 556, and 571 to 576. In another specific embodiment, an antibody provided herein, which specifically binds to GITR (e.g., human GITR), comprises (a) a heavy chain comprising the amino acid sequence of SEQ ID NO: 553 with an amino acid substitution of N to A or Q at amino acid position 298; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 553 with an amino acid substitution of N to A or Q at amino acid position 298; and (b) a light chain comprising the amino acid sequence of SEQ ID NO: 555.

In another embodiment, provided herein is an antibody or fragment thereof that binds to the same epitope of GITR (e.g., human GITR) as the antibody described herein. In another embodiment, provided herein is an isolated antibody that specifically binds to each of i) human GITR, wherein the human GITR comprises residues 26-241 of SEQ ID NO: 701 and ii) a variant of cynomolgus GITR comprising residues 26-234 of SEQ ID NO: 699, wherein the antibody does not specifically bind to cynomolgus GITR comprising residues 26-234 of SEQ ID NO: 704. In another embodiment, provided herein is an isolated antibody that specifically binds to each of i) human GITR, wherein the human GITR comprises residues 26-241 of SEQ ID NO: 701 and ii) a variant of cynomolgus GITR comprising residues 26-234 of SEQ ID NO: 699, wherein the antibody does not exhibit substantial binding to cynomolgus GITR comprising residues 26-234 of SEQ ID NO: 704. In another embodiment, provided herein is an isolated antibody that specifically binds to human GITR, wherein the human GITR comprises residues 26-241 of SEQ ID NO: 701, wherein the binding between the antibody and a variant GITR is substantially weakened relative to the binding between the antibody and the human GITR, and wherein the variant GITR comprises residues 26-241 of SEQ ID NO: 701 except for an amino acid substitution selected from the group consisting of D60A and G63A. In one embodiment, the substitution is D60A. In another embodiment, the substitution is G63A. In another embodiment, provided herein is an isolated antibody that specifically binds to human GITR, wherein the human GITR comprises residues 26-241 of SEQ ID NO: 701, and wherein the antibody binds to an epitope comprising residues 60-63 of SEQ ID NO: 701. In another embodiment, provided herein is an isolated antibody that specifically binds to human GITR, wherein the human GITR comprises residues 26-241 of SEQ ID NO: 701, and wherein the antibody binds to at least one residue within the amino acid sequence set forth by residues 60-63 of SEQ ID NO: 701. In one embodiment, the antibody binds to at least one residue selected from the group consisting of residues 60, 62, and 63 of SEQ ID NO: 701. In one embodiment, the antibody binds to at least one residue selected from the group consisting of residues 62 and 63 of SEQ ID NO: 701. In one embodiment, the antibody activates or enhances an activity of the human GITR. In another embodiment, provided herein is an isolated antibody that specifically binds human GITR, wherein the human GITR comprises residues 26-241 of SEQ ID NO:701, and wherein the antibody binds an epitope of the human GITR comprising at least one of residues 60 or 63 of SEQ ID NO:701. In another embodiment provided herein is an isolated antibody that specifically binds to human GITR, wherein the antibody exhibits, as compared to binding to human GITR, reduced or absent binding to a protein identical to human GITR except for the presence of a D60A or G63A amino acid substitution. In one embodiment, the antibody induces, activates or enhances an activity of the human GITR. In another embodiment, provided herein is an antibody or antigen-binding fragment thereof that competes with an antibody or antigen-binding fragment thereof described herein for binding to GITR (e.g., human GITR). In a specific embodiment, provided herein is an antibody or antigen-binding fragment thereof that competes with antibody or antigen-binding fragment thereof described herein for binding to GITR (e.g., human GITR) to the extent that the antibody or antigen-binding fragment thereof described herein self-competes for binding to GITR (e.g., human GITR). In another specific embodiment, provided herein is a first antibody or antigen-binding fragment thereof that competes with an antibody or antigen-binding fragment thereof described herein for binding to GITR (e.g., human GITR), wherein the first antibody or antigen-binding fragment thereof competes for binding in an assay comprising the following steps: (a) incubating GITR-transfected cells with the first antibody or antigen-binding fragment thereof in unlabeled form in a container; (b) adding the antibody or antigen-binding fragment thereof described herein in labeled form to the cells in the container and incubating the cells in the container; and (c) detecting the binding of the antibody or antigen-binding fragment thereof described herein in labeled form to the cells. In another specific embodiment, provided herein is a first antibody or antigen-binding fragment thereof competes with an antibody or antigen-binding fragment thereof described herein for binding to GITR (e.g., human GITR), wherein the competition is exhibited as reduced binding of first antibody or antigen-binding fragment thereof to GITR (e.g., human GITR) by more than 80% (e.g., 85%, 90%, 95%, or 98%, or between 80% to 85%, 80% to 90%, 85% to 90%, or 85% to 95%).

In certain embodiments, an antibody or fragment thereof provided herein, which specifically binds to GITR (e.g., human GITR), activates, induces or enhances an activity of GITR (e.g., human GITR). In specific embodiments, an antibody provided herein, which specifically binds to GITR (e.g., human GITR), is a humanized antibody, murine antibody or chimeric antibody. In certain embodiments, an antibody provided herein, which specifically binds to GITR (e.g., human GITR), binds to GITR (e.g., human GITR) with a $K_D$ in the range of about 0.5 nM to 5 nM. In certain embodiments, an antibody provided herein, which specifically binds to GITR (e.g., human GITR), comprises a detectable label. In specific embodiments, an antibody provided herein is isolated.

In certain embodiments, an antibody or fragment described herein, which immunospecifically binds to GITR (e.g., human GITR), induces, activates or enhances an activity of human GITR in a cell independent of TCR triggering. In specific embodiments, the cell is a T cell. In specific embodiments, the cell is not a T cell. In specific embodiments, the cell is selected from the group consisting of a B cell, a plasma cell, a memory cell, a natural killer cell, a granulocyte, a neutrophil, an eosinophil, a basophil, a mast cell, a monocyte, a dendritic cell, a plasmacytoid dendritic cell, an NKT cell, and a macrophage. In specific embodiments, an antibody described herein, which immunospecifically binds to GITR (e.g., human GITR), induces, activates, or enhances an activity of NF-κB independent of TCR triggering. In certain embodiments, the activity of NF-κB can be assessed in, e.g., an assay comprising the following steps: (a) incubating T cells (e.g., Jurkat cells) expressing a NF-κB-luciferase reporter construct (e.g., GloResponse NF-κB-luc2P construct) and GITR (e.g., human GITR) with the antibody described herein or an isotype control antibody at an antibody concentration of, e.g., 12.5, 10, 5, 2.5, 1.25, or 0.625 μg/ml, in the absence of an anti-CD3 antibody; and (b) reading luciferase signal after, e.g., 2, 5, 6, 8 or 18 hours of incubation using, e.g., an EnVision multilabel reader 2100, wherein a positive luciferase signal relative to the isotype control antibody indicates activity of NF-κB. In a particular embodiment, the luciferase signal is read after 5 hours of incubation.

In certain embodiments, an antibody or fragment described herein, which immunospecifically binds to GITR (e.g., human GITR), increases the percentage of polyfunctional (IFNγ+TNFα+) T cells. In specific embodiments, the increase in the percentage of polyfunctional (IFNγ+TNFα+)

T cells can be assessed in, e.g., an assay comprising the following steps: (a) incubating, e.g., human PBMCs with, e.g., an anti-CD3 antibody at various suboptimal concentrations (e.g., 0.3-5 μg/ml); and, e.g., an antibody described herein, which immunospecifically binds to GITR (e.g., human GITR), at, e.g., 5 μg/ml or an isotype control antibody, for, e.g., 3-4 days at 37° C. and 5% $CO_2$; (b) treating cells with, e.g., Brefeldin A for, e.g., 6 hours at 37° C. and 5% $CO_2$; (c) staining the surface of the cells using, e.g., an anti-CD3 antibody, an anti-CD4 antibody, and an anti-CD8α antibody; (d) staining intracellularly using, e.g., an anti-IFNγ antibody and an anti-TNFα antibody; and (e) determining the percentage of polyfunctional (IFNγ+ TNFα+) T cells relative to the isotype control antibody. In specific embodiments, the polyfunctional (IFNγ+TNFα+) T cells are selected from the group consisting of polyfunctional (IFNγ+TNFα+) CD4+ T cells and polyfunctional (IFNγ+TNFα+) CD8+ T cells.

In specific embodiments, an antibody described herein, which immunospecifically binds to GITR (e.g., human GITR), when bound to activated regulatory T cells, binds to activating Fc gamma receptors selected from the group consisting of CD16, CD32A and CD64 to a greater extent (e.g., 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold) than the antibody, when bound to activated effector T cells, binds to the activating Fc gamma receptors selected from the group consisting of CD16, CD32A and CD64, as assessed by methods described herein or known to one of skill in the art (e.g., an Fc gamma receptor IIIA (CD16) reporter assay or as described in the Examples, infra). In specific embodiments, the activating Fc gamma receptors are expressed on a cell selected from the group consisting of myeloid-derived effector cells and lymphocyte-derived effector cells. In a particular embodiment, the activating Fc gamma receptor is CD16.

In specific embodiments, an antibody described herein, which immunospecifically binds to GITR (e.g., human GITR), when bound to activated regulatory T cells, causes stronger activation of activating Fc gamma receptors selected from the group consisting of CD16, CD32A and CD64 than the antibody, when bound to activated effector T cells, causes activation of activating Fc gamma receptors selected from the group consisting of CD16, CD32A and CD64. In particular embodiments, the activation of the activating Fc gamma receptors, when the antibody described herein, which immunospecifically binds to GITR (e.g., human GITR), is bound to activated regulatory T cells, is at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold stronger than the activation of the activating Fc gamma receptors, when the antibody described herein, which immunospecifically binds to GITR (e.g., human GITR), is bound to activated effector T cells, as assessed by methods described herein or known to one of skill in the art (e.g., an Fc gamma receptor IIIA (CD16) reporter assay or as described in the Examples, infra). In specific embodiments, the activating Fc gamma receptors are expressed on a cell selected from the group consisting of myeloid-derived effector cells and lymphocyte-derived effector cells. In a particular embodiment, the activating Fc gamma receptor is CD16.

In certain embodiments, an antibody or fragment described herein, which immunospecifically binds to GITR (e.g., human GITR), increases surface expression of OX40 and/or PD-1 in activated T cells by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, 100 fold, 200 fold, 300 fold, 400 fold, 500 fold, 600 fold, 700 fold, 800 fold, 900 fold, or 1000 fold as assessed by methods described herein and/or known to one of skill in the art, relative to surface expression of OX40 and/or PD-1 in activated T cells without the antibody described herein.

In another embodiment, provided herein are nucleic acid molecules encoding a heavy chain variable region and/or a light chain variable region, or a light chain and/or a heavy chain of an antibody described herein. In a specific embodiment, the nucleic acid molecule encodes a heavy chain variable region comprising the nucleic acid sequence of SEQ ID NO: 209. In another specific embodiment, the nucleic acid molecule encodes a light chain variable region comprising the nucleic acid sequence of SEQ ID NO: 210 or SEQ ID NO: 211. In specific embodiments, the nucleic acid molecule is isolated. In certain embodiments, a vector (e.g., an isolated vector) comprises a nucleic acid molecule encoding a heavy chain variable region and/or a light chain variable region, or a light chain and/or a heavy chain of an antibody described herein. In certain embodiments, a host cell comprises the nucleic acid molecule or vector. Examples of host cells include *E. coli, Pseudomonas, Bacillus, Streptomyces*, yeast, CHO, YB/20, NS0, PER-C6, HEK-293T, NIH-3T3, HeLa, BHK, Hep G2, SP2/0, R1.1, B-W, L-M, COS 1, COS 7, BSC1, BSC40, BMT10 cells, plant cells, insect cells, and human cells in tissue culture. In a specific embodiment, provided herein is a method of producing an antibody or antigen-binding fragment thereof that specifically binds to GITR (e.g., human GITR) comprising culturing a host cell so that the nucleic acid molecule is expressed and the antibody is produced.

In another embodiment, provided herein is a method for enhancing the co-stimulation of T cells comprising incubating ex vivo T cells, which have been stimulated with a T cell receptor (TCR) complex stimulating agent (e.g., phytohaemagglutinin (PHA) and/or phorbol myristate acetate (PMA), or a TCR complex stimulating antibody, such as an anti-CD3 antibody and anti-CD28 antibody), with an antibody or antigen-binding fragment thereof described herein. In another embodiment, provided herein is a method for activating T cells comprising incubating ex vivo T cells with an antibody or antigen-binding fragment thereof described herein. In some embodiments, the method further comprises, prior to, simultaneously with, or subsequent to the incubation with the anti-GITR antibody or antigen-binding fragment thereof, incubating ex vivo the T cells with a TCR complex stimulating agent (e.g., phytohaemagglutinin (PHA) and/or phorbol myristate acetate (PMA), or a TCR complex stimulating antibody, such as an anti-CD3 antibody and anti-CD28 antibody). In some embodiments, the T cells were isolated from a subject. In certain embodiments, the stimulated and/or activated T cells are infused into a subject. In some embodiments, the T cells being infused into the subject are autologous or allogenic. In a specific embodiment, the subject is a human. In another embodiment, provided herein is a method for preferential expansion of effector T-cells over that of T-regulatory cells in a subject, comprising administering to the subject an effective amount of an antibody or antigen-binding fragment thereof described herein. In a specific embodiment, the subject is human.

In another embodiment, provided herein is a method for enhancing the expansion of T cells (e.g., CD4$^+$ and/or CD8$^+$ T cells) and/or T cell effector function, comprising incubating ex vivo the T cells with an antibody or antigen-binding fragment thereof described herein. In some embodiments, the method further comprises, prior to, simultaneously with or subsequent to incubating the T cells with the antibody or antigen-binding fragment thereof, incubating the T cells with a T cell receptor (TCR) complex stimulating agent (e.g., phytohaemagglutinin (PHA) and/or phorbol myristate acetate (PMA), or a TCR complex stimulating antibody, such as an anti-CD3 antibody and anti-CD28 antibody). In certain embodiments, the T cells were isolated from a subject. In some embodiments, the method further comprises infusing the T cells after their expansion and/or after their effector function is enhanced into a subject. In certain embodiments, the T cells being infused into the subject are autologous or allogenic. In a specific embodiment, the subject is a human.

In another embodiment, provided herein is a method for enhancing the expansion of CD8$^+$ T cells, comprising incubating ex vivo the T cells with an antibody or antigen-binding fragment thereof described herein. In some embodiments, the method further comprises, prior to, simultaneously with or subsequent to incubating the T cells with the antibody or antigen-binding fragment thereof, incubating the T cells with a T cell receptor (TCR) complex stimulating agent (e.g., phytohaemagglutinin (PHA) and/or phorbol myristate acetate (PMA), or a TCR complex stimulating antibody, such as an anti-CD3 antibody and anti-CD28 antibody). In certain embodiments, the T cells were isolated from a subject. In some embodiments, the method further comprises infusing the T cells after their expansion and/or after their effector function is enhanced into a subject. In certain embodiments, the T cells being infused into the subject are autologous or allogenic. In a specific embodiment, the subject is a human.

In another embodiment, provided herein is a method for enhancing the expansion of CD4$^+$ T cells, comprising incubating ex vivo the T cells with an antibody or antigen-binding fragment thereof described herein. In some embodiments, the method further comprises, prior to, simultaneously with or subsequent to incubating the T cells with the antibody or antigen-binding fragment thereof, incubating the T cells with a T cell receptor (TCR) complex stimulating agent (e.g., phytohaemagglutinin (PHA) and/or phorbol myristate acetate (PMA), or a TCR complex stimulating antibody, such as an anti-CD3 antibody and anti-CD28 antibody). In certain embodiments, the T cells were isolated from a subject. In some embodiments, the method further comprises infusing the T cells after their expansion and/or after their effector function is enhanced into a subject. In certain embodiments, the T cells being infused into the subject are autologous or allogenic. In a specific embodiment, the subject is a human.

In another embodiment, provided herein is a method of activating GITR or activating NF-κB comprising incubating ex vivo T cells, which have not been stimulated with a T cell receptor (TCR) complex stimulating agent (e.g., phytohaemagglutinin (PHA) and/or phorbol myristate acetate (PMA), or a TCR complex stimulating antibody, such as an anti-CD3 antibody and anti-CD28 antibody), with an antibody or antigen-binding fragment thereof described herein. In some embodiments, the T cells were isolated from a subject. In certain embodiments, the activated T cells are infused into a subject. In some embodiments, the T cells being infused into the subject are autologous or allogenic. In a specific embodiment, the subject is a human.

In another embodiment, provided herein is a method of activating T cells independent of TCR triggering comprising contacting T cells with an antibody or antigen-binding fragment thereof described herein.

In another embodiment, provided herein is a method of inducing, activating or enhancing an activity of NF-κB independent of TCR triggering comprising contacting T cells with an antibody or antigen-binding fragment thereof described herein.

In another embodiment, provided herein is a method of increasing the percentage of polyfunctional (IFNγ+TNFα+) T cells comprising contacting T cells with an antibody or antigen-binding fragment thereof described herein.

In another embodiment, provided herein is a method of increasing surface expression of OX40 and/or PD-1 in activated T cells comprising contacting T cells with an antibody or antigen-binding fragment thereof described herein.

In another embodiment, provided herein are pharmaceutical compositions comprising an antibody or antigen-binding fragment thereof, a nucleic acid molecule, a vector, or a host cell described herein, and a pharmaceutically acceptable carrier. The pharmaceutical composition can be used to modulate immune response and/or to treat and/or prevent a disorder, such as cancer or an infectious disease. In a specific embodiment, provided herein is a method of modulating an immune response in a subject, comprising administering to the subject an effective amount of the pharmaceutical composition described herein. In a particular embodiment, the immune response is enhanced or induced. In another specific embodiment, provided herein is a method for enhancing the expansion of T cells and/or T cell effector function in a subject, comprising administering to the subject an effective amount of a pharmaceutical composition described herein. In another specific embodiment, provided herein is a method for enhancing the expansion of CD8+ T cells in a subject, comprising administering to the subject an effective amount of a pharmaceutical composition described herein. In some embodiments, the disclosure provides use of an antibody as described herein in the manufacture of a medicament for the treatment of cancer. In certain embodiments, the disclosure provides an antibody as described herein for use in the treatment of cancer. In certain embodiments, the disclosure provides use of a pharmaceutical composition as described herein in the manufacture of a medicament for the treatment of cancer. In certain embodiments, the disclosure provides a pharmaceutical composition as described herein for use in the treatment of cancer. In another specific embodiment, provided herein is a method of treating cancer in a subject, comprising administering to the subject an effective amount of the pharmaceutical composition described herein. In certain embodiments, the method of treating cancer further comprises administering an anti-cancer agent to the subject. Examples of anti-cancer agents that can be administered to a subject in combination with a pharmaceutical composition described herein are described in Section 5.4, infra (e.g., Sections 5.4.1 and 5.4.1.1). In a specific embodiment, the anti-cancer agent is a vaccine. In a particular embodiment, the vaccine comprises a heat shock protein peptide complex (HSPPC), in which the HSPPC comprises a heat shock protein (e.g., a gp96 protein) complexed with one or more antigenic peptides (e.g., tumor-associated antigenic peptides). In certain embodiments, the cancer treated is squamous cell cancer, small-cell lung cancer, non-small cell lung cancer, gastrointestinal cancer, Hodgkin's or non- Hodgkin's lymphoma, pancreatic cancer, glioblastoma, glioma, cervical cancer, ovarian cancer, liver cancer, bladder cancer, breast cancer, colon cancer, colorectal cancer, endometrial carcinoma, myeloma, salivary gland carcinoma, kidney cancer, basal cell carcinoma, melanoma, prostate cancer, vulval cancer, thyroid cancer, testicular cancer, esophageal cancer, or a type of head or neck cancer. In certain embodiments, the cancer treated is desmoplastic melanoma, inflammatory breast cancer, thymoma, rectal cancer, anal cancer, or surgically treatable or non-surgically treatable brain stem glioma. In a specific embodiment, the subject treated is a human.

In another embodiment, provided herein is a method for activating T cells independent of TCR triggering in a subject, comprising administering to the subject an effective amount of the pharmaceutical composition described herein.

In another embodiment, provided herein is a method for inducing, activating or enhancing an activity of NF-κB independent of TCR triggering in a subject, comprising administering to the subject an effective amount of the pharmaceutical composition described herein.

In another embodiment, provided herein is a method for increasing the percentage of polyfunctional (IFNγ+TNFα+) T cells in a subject, comprising administering to the subject an effective amount of the pharmaceutical composition described herein.

In another embodiment, provided herein is a method for increasing surface expression of OX40 and/or PD-1 in activated T cells in a subject, comprising administering to the subject an effective amount of the pharmaceutical composition described herein.

The antibody as described herein can be used in combination with an IDO inhibitor for treating cancer. In one embodiment, provided herein is a method of treating cancer in a subject, comprising administering to the subject an effective amount of the pharmaceutical composition described herein, wherein the method further comprises administering to the subject an inhibitor of indoleamine-2, 3-dioxygenase (IDO). The IDO inhibitor as described herein for use in treating cancer is present in a solid dosage form of a pharmaceutical composition such as a tablet, a pill or a capsule, wherein the pharmaceutical composition includes an IDO inhibitor and a pharmaceutically acceptable excipient. As such, the antibody as described herein and the IDO inhibitor as described herein can be administered separately, sequentially or concurrently as separate dosage forms. In one embodiment, the antibody is administered parenterally and the IDO inhibitor is administered orally. In particular embodiments, the inhibitor is selected from the group consisting of epacadostat (Incyte Corporation), F001287 (*Flexus* Biosciences), indoximod (NewLink Genetics), and NLG919 (NewLink Genetics). Epacadostat has been described in PCT Publication No. WO 2010/005958, which is incorporated herein by reference in its entirety for all purposes. In one embodiment, the inhibitor is epacadostat. In another embodiment, the inhibitor is F001287. In another embodiment, the inhibitor is indoximod. In another embodiment, the inhibitor is NLG919.

The antibody as described herein can be used in combination with a checkpoint targeting agent for treating cancer. In one embodiment, provided herein is a method of treating cancer in a subject, comprising administering to the subject an effective amount of the pharmaceutical composition described herein, wherein the method further comprises administering to the subject a checkpoint targeting agent. In some embodiments, the checkpoint targeting agent is selected from the group consisting of an antagonist of PD-1 (e.g., an antagonist anti-PD-1 antibody), an antagonist of PD-L1 (e.g., an antagonist anti-PD-L1 antibody), an antagonist of PD-L2 (e.g., an antagonist anti-PD-L2 antibody), an antagonist of CTLA-4 (e.g., an antagonist anti-CTLA-4 antibody), an antagonist of TIM-3 (e.g., an antagonist anti-TIM-3 antibody), an antagonist of LAG-3 (e.g., an antagonist anti-LAG-3 antibody), and an agonist of OX40 (e.g., an agonist anti-OX40 antibody). In some embodiments, a checkpoint targeting agent, e.g., an antagonist of PD-1 (e.g., an antagonist anti-PD-1 antibody) or an agonist of OX40 (e.g., an agonist anti-OX40 antibody) is administered simultaneously with the anti-GITR antibody. In some embodiments, a checkpoint targeting agent, e.g., an antagonist of PD-1 (e.g., an antagonist anti-PD-1 antibody) or an agonist of OX40 (e.g., an agonist anti-OX40 antibody) is administered prior to the administration of the anti-GITR antibody. In some embodiments, a checkpoint targeting agent, e.g., an antagonist of PD-1 (e.g., an antagonist anti-PD-1 antibody) or an agonist of OX40 (e.g., an agonist anti-OX40 antibody) is administered subsequent to the administration of the anti-GITR antibody.

The antibody as described herein can be used in combination with an anti-CD25 antibody. In some embodiments, an anti-CD25 antibody is administered simultaneously with the anti-GITR antibody. In some embodiments, an anti-CD25 antibody is administered prior to the administration of the anti-GITR antibody. In some embodiments, an anti-CD25 antibody is administered subsequent to the administration of the anti-GITR antibody.

In another specific embodiment, provided herein is a method of treating cancer in a subject comprising administering an antagonist anti-PD-1 antibody to a subject in need thereof who has received an anti-GITR antibody, wherein the PD-1 antibody is administered at a time at which the anti-GITR antibody has increased expression of PD-1 in the subject relative to expression of PD-1 in the subject at the time of the administering. In another specific embodiment, provided herein is a method of treating cancer in a subject comprising administering an agonist anti-OX40 antibody to a subject in need thereof who has received an anti-GITR antibody, wherein the OX40 antibody is administered at a time at which the anti-GITR antibody has increased expression of OX40 in the subject relative to expression of OX40 in the subject at the time of the administering. In certain embodiments, the anti-GITR antibody induces, activates, or enhances an activity of GITR.

In another specific embodiment, provided herein is a method of treating cancer in a subject comprising administering an anti-GITR antibody to a subject in need thereof, wherein the anti-GITR antibody increases expression of PD-1 in the subject relative to expression of PD-1 in the subject at the time of the administering, and administering an antagonist anti-PD-1 antibody to the subject when expression of PD-1 is increased. In another specific embodiment, provided herein is a method of treating cancer in a subject comprising administering an anti-GITR antibody to a subject in need thereof, wherein the anti-GITR antibody increases expression of OX40 in the subject relative to expression of OX40 in the subject at the time of the administering, and administering an agonist OX40 antibody to the subject when expression of OX40 is increased. In certain embodiments, the anti-GITR antibody induces, activates, or enhances an activity of GITR.

In another specific embodiment, provided herein is a method of treating cancer or a viral infection in a subject, the method comprising the steps of: (a) incubating T cells ex vivo with an antibody or antigen-binding fragment thereof described herein; and (b) infusing the T cells into the subject. In a specific embodiment, the T cells infused into the subject are autologous or allogenic. In certain embodiments, the T cells were isolated from a subject. In some embodiments, the T cells are not incubated with a T cell receptor (TCR) complex stimulating agent (e.g., phytohaemagglutinin (PHA) and/or phorbol myristate acetate (PMA), or a TCR complex stimulating antibody, such as an anti-CD3 antibody and anti-CD28 antibody). In certain embodiments, the method further comprises, prior to step (a): (1) assaying the T cells for cell surface expression of GITR; and (2) if step (1) does not result in detection of GITR above a threshold value, inducing expression of GITR on the surface of the T cells by incubating the T cells with a T cell receptor (TCR) complex stimulating agent (e.g., phytohaemagglutinin (PHA) and/or phorbol myristate acetate (PMA), or a TCR complex stimulating antibody, such as an anti-CD3 antibody and anti-CD28 antibody). In some embodiments, the method further comprises, prior to, simultaneously with or subsequent to step (a), incubating the T cells with a T cell receptor (TCR) complex stimulating agent phytohaemagglutinin (PHA) and/or phorbol myristate acetate (PMA), or a TCR complex stimulating antibody, such as an anti-CD3 antibody and anti-CD28 antibody). In a specific embodiment, the subject treated is a human.

In another embodiment, provided herein is a method of treating and/or preventing an infectious disease in a subject comprising administering to the subject an effective amount of a pharmaceutical composition described herein. See Section 5.4.1.2 below for examples of infectious diseases. In another specific embodiment, provided herein is a method of treating a viral infection in a subject, comprising administering to the subject an effective amount of the pharmaceutical composition described herein. In certain embodiments, the viral infection treated is caused by a human papilloma virus (HPV), a Herpes simplex or other herpes virus, hepatitis B virus (HBV), hepatitis C virus (HCV) or other hepatitis virus, measles virus, HIV or Epstein Barr virus (EBV). In certain embodiments, the method of treating a viral infection further comprises administering an anti-viral agent to the subject. In a specific embodiment, the subject treated is a human.

In another specific embodiment, provided herein is a method of identifying an anti-GITR antibody that is capable of inducing, activating, or enhancing an activity of GITR in the absence of a TCR agonist comprising contacting a cell expressing GITR with an anti-GITR antibody in the absence of a TCR agonist and measuring GITR activity, wherein increased GITR activity compared to GITR activity in the absence of the anti-GITR antibody indicates the anti-GITR antibody is capable of inducing, activating, or enhancing an activity of GITR in the absence of a TCR agonist. In certain embodiments, the GITR activity is assessed by measuring NF-κB activity. In certain embodiments, the GITR activity is assessed by measuring activation of TRAF adaptor mediated signaling pathways, wherein the TRAF adaptor is selected from the group consisting of TRAF1, TRAF2, TRAF3, TRAF4, and TRAF5. In certain embodiments, the GITR activity is assessed by measuring activation of the MAPK/ERK pathway. In certain embodiments, the anti-GITR antibody increases the GITR activity at least two-fold compared to GITR activity in the absence of the anti-GITR antibody. In certain embodiments, the anti-GITR antibody increases the GITR activity two-fold to twenty-fold compared to GITR activity in the absence of the anti-GITR antibody. In certain embodiments, the anti-GITR antibody increases the GITR activity two-fold to ten-fold compared to GITR activity in the absence of the anti-GITR antibody. In certain embodiments, the cell is a T cell. In certain embodiments, the cell is not a T cell.

In another specific embodiment, provided herein is an anti-GITR antibody that specifically binds to human GITR, wherein said antibody is capable of inducing, activating, or enhancing an activity of GITR in a cell in the absence of TCR triggering. In another specific embodiment, provided herein is an anti-GITR antibody that specifically binds to human GITR, wherein said antibody induces, activates, or enhances an activity of NF-κB in a cell in the absence of TCR triggering. In another specific embodiment, provided herein is a method of treating cancer comprising administering to a subject in need thereof an anti-GITR antibody that specifically binds to human GITR, wherein said antibody is capable of inducing, activating, or enhancing an activity of GITR and/or NF-κB in the absence of TCR triggering.

3.1 Terminology

As used herein, the terms "about" and "approximately," when used to modify a numeric value or numeric range, indicate that deviations of 5% to 10% above and 5% to 10% below the value or range remain within the intended meaning of the recited value or range.

As used herein, the binding between a test antibody and a first antigen is "substantially weakened" relative to the binding between the test antibody and a second antigen if the binding between the test antibody and the first antigen is reduced by at least 30%, 40%, 50%, 60%, 70%, or 80% relative to the binding between the test antibody and the second antigen, e.g., in a given experiment, or using mean values from multiple experiments, as assessed by, e.g., an assay comprising the following steps: (a) expressing on the surface of cells (e.g., 1624-5 cells) the first antigen or the second antigen; (b) staining the cells expressing the first antigen or the second antigen using, e.g., 2 μg/ml of the test antibody or a polyclonal antibody in a flow cytometry analysis and recording mean fluorescence intensity (MFI) values, e.g., as the mean from more than one measurement, wherein the polyclonal antibody recognizes both the first antigen and the second antigen; (c) dividing the MFI value of the test antibody for the cells expressing the second antigen by the MFI value of the polyclonal antibody for the cells expressing the second antigen (MFI ratio$_2$); (d) dividing the MFI value of the test antibody for the cells expressing the first antigen by the MFI value of the polyclonal antibody for the cells expressing the first antigen (MFI ratio$_1$); and (e) determining the percentage of reduction in binding by calculating 100%*(1−(MFI ratio$_1$/MFI ratio$_2$)).

As used herein, an antibody does not exhibit "substantial binding" to an antigen if when measured in a flow cytometry analysis, the mean fluorescence intensity (MFI) value of the antibody to the antigen is not significantly higher than the MFI value of an isotype control antibody to the antigen or the MFI value in the absence of any antibody.

As used herein, the terms "antibody" and "antibodies" are terms of art and can be used interchangeably herein and refer to a molecule with an antigen binding site that specifically binds an antigen.

Antibodies can include, for example, monoclonal antibodies, recombinantly produced antibodies, monospecific antibodies, multispecific antibodies (including bispecific antibodies), human antibodies, humanized antibodies, chimeric antibodies, immunoglobulins, synthetic antibodies, tetrameric antibodies comprising two heavy chain and two light chain molecules, an antibody light chain monomer, an antibody heavy chain monomer, an antibody light chain dimer, an antibody heavy chain dimer, an antibody light chain-antibody heavy chain pair, intrabodies, heteroconjugate antibodies, single domain antibodies, monovalent antibodies, single chain antibodies or single-chain Fvs (scFv), camelized antibodies, affybodies, Fab fragments, F(ab')$_2$ fragments, disulfide-linked Fvs (sdFv), anti-idiotypic (anti-Id) antibodies (including, e.g., anti-anti-Id antibodies), and antigen-binding fragments of any of the above. In certain embodiments, antibodies described herein refer to polyclonal antibody populations. Antibodies can be of any type (e.g., IgG, IgE, IgM, IgD, IgA or IgY), any class (e.g., IgG$_1$, IgG$_2$, IgG$_3$, IgG$_4$, IgA$_1$ or IgA$_2$), or any subclass (e.g., IgG$_{2a}$ or IgG$_{2b}$) of immunoglobulin molecule. In certain embodiments, antibodies described herein are IgG antibodies, or a class (e.g., human IgG$_1$ or IgG$_4$) or subclass thereof. In a specific embodiment, the antibody is a humanized monoclonal antibody. In another specific embodiment, the antibody is a human monoclonal antibody, preferably that is an immunoglobulin. In certain embodiments, an antibody described herein is an IgG$_1$, or IgG$_4$ antibody.

As used herein, the terms "antigen-binding domain," "antigen-binding region," "antigen-binding fragment," and similar terms refer to a portion of an antibody molecule which comprises the amino acid residues that confer on the antibody molecule its specificity for the antigen (e.g., the complementarity determining regions (CDR)). The antigen-binding region can be derived from any animal species, such as rodents (e.g., mouse, rat or hamster) and humans.

As used herein, the terms "variable region" or "variable domain" are used interchangeably and are common in the art. The variable region typically refers to a portion of an antibody, generally, a portion of a light or heavy chain, typically about the amino-terminal 110 to 120 amino acids in the mature heavy chain and about 90 to 115 amino acids in the mature light chain, which differ extensively in sequence among antibodies and are used in the binding and specificity of a particular antibody for its particular antigen. The variability in sequence is concentrated in those regions called complementarity determining regions (CDRs) while the more highly conserved regions in the variable domain are called framework regions (FR). Without wishing to be bound by any particular mechanism or theory, it is believed that the CDRs of the light and heavy chains are primarily responsible for the interaction and specificity of the antibody with antigen. In certain embodiments, the variable region is a human variable region. In certain embodiments, the variable region comprises rodent or murine CDRs and human framework regions (FRs). In particular embodiments, the variable region is a primate (e.g., non-human primate) variable region. In certain embodiments, the variable region comprises rodent or murine CDRs and primate (e.g., non-human primate) framework regions (FRs).

The terms "VL" and "VL domain" are used interchangeably to refer to the light chain variable region of an antibody.

The terms "VH" and "VH domain" are used interchangeably to refer to the heavy chain variable region of an antibody.

The term "Kabat numbering" and like terms are recognized in the art and refer to a system of numbering amino acid residues in the heavy and light chain variable regions of an antibody, or an antigen-binding portion thereof. In certain aspects, the CDRs of an antibody can be determined according to the Kabat numbering system (see, e.g., Kabat E A & Wu T T (1971) Ann NY Acad Sci 190: 382-391 and Kabat E A et al., (1991) Sequences of Proteins of Immunological Interest, Fifth Edition, U.S. Department of Health and Human Services, NIH Publication No. 91-3242). Using the Kabat numbering system, CDRs within an antibody heavy chain molecule are typically present at amino acid positions 31 to 35, which optionally can include one or two additional amino acids, following 35 (referred to in the Kabat numbering scheme as 35A and 35B) (CDR1), amino acid positions 50 to 65 (CDR2), and amino acid positions 95 to 102 (CDR3). Using the Kabat numbering system, CDRs within an antibody light chain molecule are typically present at amino acid positions 24 to 34 (CDR1), amino acid positions 50 to 56 (CDR2), and amino acid positions 89 to 97 (CDR3). In a specific embodiment, the CDRs of the antibodies described herein have been determined according to the Kabat numbering scheme.

As used herein, the term "constant region" or "constant domain" are interchangeable and have its meaning common in the art. The constant region is an antibody portion, e.g., a carboxyl terminal portion of a light and/or heavy chain which is not directly involved in binding of an antibody to antigen but which can exhibit various effector functions, such as interaction with the Fc receptor. The constant region of an immunoglobulin molecule generally has a more conserved amino acid sequence relative to an immunoglobulin variable domain.

As used herein, the term "heavy chain" when used in reference to an antibody can refer to any distinct type, e.g., alpha ($\alpha$), delta ($\delta$), epsilon ($\epsilon$), gamma ($\gamma$) and mu ($\mu$), based on the amino acid sequence of the constant domain, which give rise to IgA, IgD, IgE, IgG and IgM classes of antibodies, respectively, including subclasses of IgG, e.g., IgG$_1$, IgG$_2$, IgG$_3$ and IgG$_4$.

As used herein, the term "light chain" when used in reference to an antibody can refer to any distinct type, e.g., kappa ($\kappa$) or lambda ($\lambda$) based on the amino acid sequence of the constant domains. Light chain amino acid sequences are well known in the art. In specific embodiments, the light chain is a human light chain.

"Binding affinity" generally refers to the strength of the sum total of non-covalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant ($K_D$). Affinity can be measured and/or expressed in a number of ways known in the art, including, but not limited to, equilibrium dissociation constant ($K_D$), and equilibrium association constant ($K_A$). The $K_D$ is calculated from the quotient of $k_{off}/k_{on}$, whereas $K_A$ is calculated from the quotient of $k_{on}/k_{off}$. $k_{on}$ refers to the association rate constant of, e.g., an antibody to an antigen, and $k_{off}$ refers to the dissociation of, e.g., an antibody to an antigen. The $k_{on}$ and $k_{off}$ can be determined by techniques known to one of ordinary skill in the art, such as BIAcore® or KinExA.

As used herein, a "conservative amino acid substitution" is one in which the amino acid residue is replaced with an amino acid residue having a similar side chain. Families of amino acid residues having side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). In certain embodiments, one or more amino acid residues within a CDR(s) or within a framework region(s) of an antibody or antigen-binding fragment thereof can be replaced with an amino acid residue with a similar side chain.

As used herein, an "epitope" is a term in the art and refers to a localized region of an antigen to which an antibody can specifically bind. An epitope can be, for example, contiguous amino acids of a polypeptide (linear or contiguous epitope) or an epitope can, for example, come together from two or more non-contiguous regions of a polypeptide or polypeptides (conformational, non-linear, discontinuous, or non-contiguous epitope). In certain embodiments, the epitope to which an antibody binds can be determined by, e.g., NMR spectroscopy, X-ray diffraction crystallography studies, ELISA assays, hydrogen/deuterium exchange coupled with mass spectrometry (e.g., liquid chromatography electrospray mass spectrometry), array-based oligopeptide scanning assays, and/or mutagenesis mapping (e.g., site-directed mutagenesis mapping). For X-ray crystallography, crystallization may be accomplished using any of the known methods in the art (e.g., Giegé R et al., (1994) Acta Crystallogr D Biol Crystallogr 50(Pt 4): 339-350; McPherson A (1990) Eur J Biochem 189: 1-23; Chayen N E (1997) Structure 5: 1269-1274; McPherson A (1976) J Biol Chem 251: 6300-6303). Antibody:antigen crystals may be studied using well known X-ray diffraction techniques and may be refined using computer software such as X-PLOR (Yale University, 1992, distributed by Molecular Simulations, Inc.; see e.g. Meth Enzymol (1985) volumes 114 & 115, eds Wyckoff H W et al., U.S. 2004/0014194), and BUSTER (Bricogne G (1993) Acta Crystallogr D Biol Crystallogr 49(Pt 1): 37-60; Bricogne G (1997) Meth Enzymol 276A: 361-423, ed Carter C W; Roversi P et al., (2000) Acta Crystallogr D Biol Crystallogr 56(Pt 10): 1316-1323). Mutagenesis mapping studies may be accomplished using any method known to one of skill in the art. See, e.g., Champe M et al., (1995) J Biol Chem 270: 1388-1394 and Cunningham B C & Wells J A (1989) Science 244: 1081-1085 for a description of mutagenesis techniques, including alanine scanning mutagenesis techniques. In a specific embodiment, the epitope of an antibody or antigen-binding fragment thereof is determined using alanine scanning mutagenesis studies, such as described in Section 6, infra.

As used herein, the terms "immunospecifically binds," "immunospecifically recognizes," "specifically binds," and "specifically recognizes" are analogous terms in the context of antibodies and refer to molecules that bind to an antigen (e.g., epitope or immune complex) as such binding is understood by one skilled in the art. For example, a molecule that specifically binds to an antigen may bind to other peptides or polypeptides, generally with lower affinity as determined by, e.g., immunoassays, BIAcore®, KinExA 3000 instrument (Sapidyne Instruments, Boise, Id.), or other assays known in the art. In a specific embodiment, molecules that immunospecifically bind to an antigen bind to the antigen with a $K_A$ that is at least 2 logs, 2.5 logs, 3 logs, 4 logs or greater than the $K_A$ when the molecules bind to another antigen.

In another specific embodiment, molecules that immunospecifically bind to an antigen do not cross react with other proteins under similar binding conditions. In another specific embodiment, molecules that immunospecifically bind to an antigen do not cross react with other non-GITR proteins. In a specific embodiment, provided herein is an antibody or fragment thereof that binds to GITR with higher affinity than to another unrelated antigen. In certain embodiments, provided herein is an antibody or fragment thereof that binds to GITR (e.g., human GITR) with a 20%, 25%, 30%, 35%, 40%, 45%, 50%, 55%, 60%, 65%, 70%, 75%, 80%, 85%, 90%, 95% or higher affinity than to another, unrelated antigen as measured by, e.g., a radioimmunoassay, surface plasmon resonance, or kinetic exclusion assay. In a specific embodiment, the extent of binding of an anti-GITR antibody or antigen-binding fragment thereof described herein to an unrelated, non-GITR protein is less than 10%, 15%, or 20% of the binding of the antibody to GITR protein as measured by, e.g., a radioimmunoassay.

In a specific embodiment, provided herein is an antibody or fragment thereof that binds to human GITR with higher affinity than to another species of GITR. In certain embodiments, provided herein is an antibody or fragment thereof that binds to human GITR with a 5%, 10%, 15%, 20%, 25%, 30%, 35%, 40%, 45%, 50%, 55%, 60%, 65%, 70% or higher affinity than to another species of GITR as measured by, e.g., a radioimmunoassay, surface plasmon resonance, or kinetic exclusion assay. In a specific embodiment, an antibody or fragment thereof described herein, which binds to human GITR, will bind to another species of GITR protein with less than 10%, 15%, or 20% of the binding of the antibody or fragment thereof to the human GITR protein as measured by, e.g., a radioimmunoassay, surface plasmon resonance, or kinetic exclusion assay.

As used herein, the terms "glucocorticoid-induced TNFR family related receptor" or "GITR" or "GITR polypeptide" refer to GITR including, but not limited to, native GITR, an isoform of GITR, or an interspecies GITR homolog of GITR. GITR is a 26 kDa type I transmembrane protein. GenBank™ accession numbers BC152381 and BC152386 provide exemplary human GITR nucleic acid sequences. Swiss-Prot accession number Q9Y5U5-1 (TNR18_HUMAN; SEQ ID NO: 701) and GenBank™ accession number NP_004186 provide exemplary human GITR amino acid sequences for isoform 1. This amino acid sequence is 241 amino acids in length with the first 25 amino acid residues encoding the signal sequence. Isoform 1 is a type I membrane protein. An exemplary mature amino acid sequence of human GITR is provided as SEQ ID NO: 700. In contrast, isoform 2 is a secreted form of human GITR and is approximately 255 amino acids in length. Swiss-Prot accession number Q9Y5U5-2 and GenBank™ accession number NP_683699 provide exemplary human GITR amino acid sequences for isoform 2. Isoform 3 of human GITR is approximately 234 amino acids in length. Swiss-Prot accession number Q9Y5U5-3 and GenBank™ accession number NP_683700 (isoform 3 precursor) provide exemplary human GITR amino acid sequences for isoform 3. In a specific embodiment, the GITR is human GITR. In another specific embodiment, the GITR is human GITR isoform 1 (SEQ ID NO: 701). In certain embodiments, the GITR is human isoform 2 (SEQ ID NO: 702) or isoform 3 (SEQ ID NO: 703). GITR is also known as tumor necrosis factor receptor superfamily member 18 (TNFRSF18), activation-inducible TNFR family receptor (AITR), GITR-D, and CD357. Human GITR is designated GeneID: 8784 by Entrez Gene.

The amino acid sequence of an immature form of an exemplary GITR protein from cynomolgus monkey is provided in SEQ ID NO: 704. The mature form of this exemplary protein is amino acids 26-234 of SEQ ID NO: 704.

As used herein, the terms "GITR ligand" and "GITRL" refer to glucocorticoid-induced TNFR-related protein ligand. GITRL is otherwise known as activation-induced TNF-related ligand (AITRL) and tumor necrosis factor ligand superfamily member 18 (TNFSF18). GenBank™ accession number AF125303 provides an exemplary human GITRL nucleic acid sequence. GenBank™ accession number NP_005083 and Swiss-Prot accession number Q9UNG2 provide exemplary human GITRL amino acid sequences. In a particular embodiment, the GITRL is a human GITRL of SEQ ID NO: 716.

As used herein, the term "host cell" can be any type of cell, e.g., a primary cell, a cell in culture, or a cell from a cell line. In specific embodiments, the term "host cell" refers to a cell transfected with a nucleic acid molecule and the progeny or potential progeny of such a cell. Progeny of such a cell may not be identical to the parent cell transfected with the nucleic acid molecule, e.g., due to mutations or environmental influences that may occur in succeeding generations or integration of the nucleic acid molecule into the host cell genome.

As used herein, the term "effective amount" in the context of the administration of a therapy to a subject refers to the amount of a therapy that achieves a desired prophylactic or therapeutic effect. Examples of effective amounts are provided in Section 5.4.1.3, infra.

As used herein, the terms "subject" and "patient" are used interchangeably. The subject can be an animal. In some embodiments, the subject is a mammal such as a non-primate (e.g., cow, pig, horse, cat, dog, rat etc.) or a primate (e.g., monkey or human), most preferably a human. In certain embodiments, such terms refer to a non-human animal (e.g., a non-human animal such as a pig, horse, cow, cat or dog). In some embodiments, such terms refer to a pet or farm animal. In specific embodiments, such terms refer to a human.

4. BRIEF DESCRIPTION OF THE FIGURES

FIG. 1 is a Western Blot under non-reducing conditions showing specificity of anti-GITR antibody 231-32-15 versus an isotype control. Antibody is blotted against human GITR recombinant protein (Hu GITR recomb protein), mouse GITR recombinant protein (Mu GITR recomb protein), CMS5A cells expressing recombinant human GITR (CMS5A-huGITR), wild-type CMS5A cells (CMS5A-wt), protein from CD4$^+$ Activated cells (CD4$^+$ Activated) and protein from CD4$^+$ Untreated cells (CD4$^+$ Untreated). 231-32-15 reactivity is seen against human GITR, recombinant human GITR in CMS5A cells, and natural human GITR in activated CD4$^+$ cells.

FIGS. 2A and 2B show FACS analysis of competitive binding of the anti-GITR antibodies versus commercial (R&D Systems) anti-GITR mAb. In FIG. 2A blocking of the R&D Systems mAb is tested using the R&D mAb and the test antibodies (antibody 1042-7, antibody 1039-45, antibody 1333-21 and antibody 32-15) as indicated in the figure. The condition 'no antibody' shows binding of the R&D Systems mAb alone, in the absence of test antibodies. FIG. 2B shows blocking of the anti-GITR antibody 231-1039-45 using no mAb, the R&D Systems mAb and the test antibodies (antibody 1042-7, antibody 1039-45, antibody 1333-21 and antibody 32-14) as indicated in the figure. The condition 'no antibody' shows binding of antibody 231-1039-45 alone, in the absence of test antibodies.

FIGS. 3A, 3B and 3C: FIG. 3A depicts staining of CMS5A-GITR by antibodies 1333-21 batch 1, 1333-21 batch 2 and R&D antibody at varying concentrations of antibody. FIG. 3B graphs the fluorescence intensity of ex-vivo PBMC CD3-CD19-GITR+ and CD4+CD25+ GITR+ cells on staining with antibodies 1042-7, 32-15, 1039-45, 1333-21 and R&D antibody. FIG. 3C provides FACS analysis of CD3-CD19-GITR+ and CD4+CD25+ GITR+ cells by antibody 1333-21 and the R&D Systems antibody.

FIG. 4 depicts an assessment of the costimulatory effect of anti-GITR antibody on CD4+ T cells in combination with varying concentrations of anti-CD3 (OKT3) antibody. In the top panel the % CFSE-low cells is plotted for each antibody tested (PBS control, R&D, 1042-7, 32-15, 1039-45 and 1333-21) in combination with decreasing concentrations of OKT3 antibody (5 µg/ml, 1 µg/ml, 0.2 µg/ml, 0.04 µg/ml and 0 µg/ml). In the bottom panel the concentration of IFNγ (pg/ml) is plotted for each antibody tested (PBS control, R&D, 1042-7, 32-15, 1039-45 and 1333-21) in combination with decreasing concentrations of the OKT3 antibody (5 µg/ml, 1 µg/ml, 0.2 µg/ml, 0.04 µg/ml and 0 µg/ml).

FIG. 5 shows GITRL-PE binding to GITR in the presence of anti-GITR antibodies chimeric parental 231-32-15 and m6C8. A further antibody SK48E26, which recognizes IL-1β, was used as a negative control. The percentage of GITRL-PE binding was measured by suspension array technology (Luminex® 200 system) in the presence of increasing antibody concentrations (12, 37, 111, 333, 1000, 3000 and 9000 ng/ml). FIG. 5 shows the results from four independent repeats of this assay performed in duplicate and standard deviation was determined from n=8.

FIG. 6 is a similar graph to that shown in FIG. 5 where the percentage of GITRL-PE binding was measured by suspension array technology (Luminex® 200 system) in the presence of increasing antibody concentrations (12, 37, 111, 333, 1000, 3000 and 9000 ng/ml). The anti-GITR antibodies tested were the chimeric parental 231-32-15 antibody and the two humanized variants Hum231#1 and Hum231#2. This figure shows the results from one experiment performed in duplicate.

FIG. 7 shows GITR ligand binding to GITR in the presence of mAbs as measured by surface plasmon resonance (BIAcore® T100/200). The anti-GITR antibodies tested were chimeric parental 231-32-15, humanized variants Hum231#1 and Hum231#2 and m6C8. The negative control was the anti-IL-113 antibody SK48E26.

FIGS. 8A and 8B show FACS plots of the results of a suboptimal CD3 stimulation assay to assess the effects of stimulation of anti-GITR antibodies on enriched CD4$^+$ T cells from two different buffy coats. FIG. 8A shows the FACS analysis of cell number and proliferation of CD4 T cells from a high responder to stimulation (buffy coat 6), whereas FIG. 8B shows the FACS analysis for a low responder (buffy coat 8). Cell proliferation (CFSE; x-axis) is shown for 10 µg/ml of anti-GITR antibody (chimeric parental 231-32-15 antibody and humanized variants Hum231#1 and Hum231#2). The controls used were either anti-CD3/anti-CD28 antibody alone or no stimulation. The assay was performed in triplicate.

FIGS. 9A and 9B are histograms showing the effect of anti-GITR humanized variant antibodies Hum231#1 and Hum231#2 on enriched CD4 T cell proliferation (FIG. 9A) and cell number (FIG. 9B), compared to the antibody m6C8, in a suboptimal CD3 stimulation assay. The antibodies were used at a concentration of 10 µg/ml. The end column (solid black fill; FIGS. 9A and 9B) indicates anti-CD3/anti-CD28 simulation without the addition of any anti-GITR antibodies.

FIGS. 10A, 10B, 10C and 10D show the analysis of cytokine production for IFNγ, IL-6, IL-10 and TNFα, respectively induced by the administration of anti-GITR antibodies in a suboptimal CD3 stimulation assay. The anti-GITR antibodies tested were chimeric parental 231-32-

15 and humanized variants Hum231#1 and Hum231#2 at concentrations of 10 µg/ml and 5 µg/ml.

FIG. 11 is a histogram showing the further titration of anti-GITR antibodies and their effect on cell proliferation in a suboptimal CD3 stimulation assay. The chimeric parental 231-32-15 antibody and humanized variants Hum231#1 and Hum231#2 were used at concentrations of 10 µg/ml, 5 µg/ml and 2.5 µg/ml.

FIGS. 12A and 12B show the further titration of anti-GITR antibodies and their effect on IFNγ production in a suboptimal CD3 stimulation assay. The chimeric parental 231-32-15 antibody and humanized variants Hum231#1 and Hum231#2 were used at concentrations of 10 µg/ml, 5 µg/ml and 2.5 µg/ml as plate bound (FIG. 12A) or 20 µg/ml, 10 µg/ml and 5 µg/ml as soluble antibodies (FIG. 12B).

FIG. 13 is a set of bar graphs showing the results of co-stimulation with 5 µg/ml, plate-bound Hum231#2 on cytokine secretion by PBMCs in a suboptimal CD3 stimulation assay. The data shown in FIG. 13 are from two donors tested on day 2 and day 4 post-stimulation. The max fold induction over isotype control was plotted for six different cytokines (IFNγ, IL-2, TNFα, IL-10, IL-13 and IL-4). The error bars represent standard deviation for a replicate of two for each cytokine Each donor has been tested in at least three individual experiments.

FIGS. 14A, 14B and 14C are results of intracellular cytokine staining assays measuring the production of IFNγ and TNFα, induced by plate-bound Hum231#2, Hum231#2w or pab1989 (the IgG4 counterpart of Hum231#2w) under suboptimal CD3 stimulation. FIG. 14A is a set of flow cytometry plots showing the co-staining of IFNγ and TNFα for CD4+ and CD8+ T cells. The percentage of IFNγ+ monofunctional T cells, TNFα+ monofunctional T cells or IFNγ+TNFα+ polyfunctional T cells was plotted for Hum231#2, Hum231#2w, pab1989 or isotype control over a range of suboptimal anti-CD3 antibody concentrations (FIGS. 14B and 14C). Each dot in FIGS. 14B and 14C represents a replicate of two for the condition tested. The error bars represent standard deviation. The anti-GITR antibodies were used at a concentration of 5 µg/ml. The graphs are representative of experiments using PBMCs from six (FIGS. 14A and 14B) and four (FIG. 14C) different donors, respectively.

FIGS. 15A, 15B and 15C are a set of bar graphs showing results of experiments comparing the anti-GITR antibody Hum231#2 under different cross-linking conditions. FIG. 15A is a bar graph showing the maximum fold induction from isotype control for the percentage of IFNγ+TNFα+ polyfunctional CD8+ T cells using PBMCs co-stimulated by 5 µg/ml plate-bound (PB) or soluble Hum231#2 or isotype control. The error bars represent standard deviation. * represents p<0.05 and ** represents p<0.005 (unpaired T-test). In FIGS. 15B and 15C, the maximum fold induction over isotype control for six different cytokines was plotted for either plate-bound Hum231#2 (FIG. 15B) or anti-Fc cross-linked Hum231#2 (FIG. 15C). The error bars represent standard deviation from a replicate of two for each cytokine FIGS. 16A and 16B show the results of anti-CD3/anti-CD28 and anti-GITR antibody stimulation on T effector (T-eff) and T regulatory cells (Tregs). FIG. 16A shows that activated T-effector and T-regulatory cells express GITR on their cell surface following stimulation with anti-CD3/anti-CD28 alone or in conjunction with anti-GITR antibodies. However, as is shown in FIG. 16B, costimulation with anti-GITR antibodies preferentially expands effector T-cells over T-regulatory cells. Cell expansion/proliferation (CFSE; y-axis) is shown for 10 µg/ml of anti-GITR antibodies (chimeric parental 231-32-15 antibody and humanized variants Hum231#1 and Hum231#2) on buffy coat 8. The controls used were either anti-CD3/anti-CD28 antibody at 125 ng/ml alone or no stimulation.

FIGS. 17A and 17B show the results on T cell proliferation by the anti-GITR antibodies tested. FIG. 17A shows the proliferation of CD4 cells and FIG. 17B shows the proliferation of CD8 cells in total PBMCs stimulated with 31.25 ng/ml anti-CD3 antibody. Chimeric parental 231-32-15 antibody and humanized variants Hum231#1 and Hum231#2 were tested at a concentration of 10 µg/ml.

FIGS. 18A, 18B and 18C are graphs showing the results of a GITR NF-κB-luciferase reporter assay in the absence or presence of 0.3 µg/ml of a plate-bound anti-CD3 antibody (Clone SP34). FIG. 18A is a graph showing the luciferase relative light units (RLU) at a range of anti-GITR antibody concentrations at 18-hour post-stimulation in the presence of the anti-CD3 antibody. FIG. 18B is a graph showing luciferase RLU at different anti-GITR antibody concentrations at 5-hour post-stimulation in the absence of the anti-CD3 antibody. FIG. 18C is a graph showing the highest ratios of luciferase expression (GITR Ab/isotype control) at 0, 2, 5, 6, 8 and 18 hrs post-stimulation. The error bars represent standard deviation from duplicates. The anti-GITR antibodies tested were Hum231#2w and m6C8. The data shown are representative of four experiments with anti-CD3 antibody or two experiments without anti-CD3 antibody.

FIG. 19A is a bar graph showing the normalized receptor density of human GITR on activated nTregs, CD4+ T cells or CD8+ T cells as measured by flow cytometry. The anti-GITR antibody used was a PE-conjugated mouse anti-human GITR antibody (Biolegend: 621; 311604/B171072). The error bars represent standard deviation. FIG. 19B is a graph examining the anti-GITR antibody Hum231#2w using an Fc gamma receptor IIIA (CD16) reporter cell line. Jurkat NFAT-luciferase reporter cells overexpressing CD16A with the high affinity 158 V/V polymorphism were co-cultured with activated primary nTregs and T effector cells for 20 hours at 37° C. in the presence of Hum231#2w or an isotype control. The relative light units (RLU) were recorded after 20 hours, representing CD16A binding. ΔRLU represents the RLU of the anti-GITR antibody minus that of the isotype control. The error bars represent standard deviation (n=2). The data shown are representative of experiments using cells from three donors. FIG. 19C is a set of histograms showing the surface expression of GITR measured by flow cytometry. Samples were collected from the blood of healthy human donors (a-c, n=3) or from tumor tissues of non-small cell lung cancer patients (NSCLC) (d-f, n=3). The cell populations were defined as: Tconv (CD3+, CD4+, CD8a−, CD25low, FOXP3−) or Treg (CD3+, CD4+, CD8a−, CD25high, FOXP3+).

FIGS. 20A, 20B and 20C are results from experiments using PBMCs from African green monkey (AGM). FIG. 20A is a set of flow cytometry plots of the staining of activated CD4+ and CD8+ T cells from African green monkey (AGM) using the anti-GITR antibody Hum231#2 and an anti-PD-1 antibody. Healthy AGM PBMCs were activated with anti-CD3 antibody (clone SP34.2) or ConA plus IL-2 (20 U/ml) for 3 days. The flow cytometry plots are representative of experiments using PBMCs from three different AGMs. FIGS. 20B and 20C are results of a CD3 substimulation assay using AGM PBMCs. FIG. 20B is a pair of flow cytometry plots showing the co-staining of CD8 and IFNγ for cells co-stimulated by Hum231#2w or isotype control. In FIG. 20C, the percentage of IFNγ+AGM CD8+ T cells was plotted for different anti-GITR antibody concentrations. Each dot represents a replicate of two wells and the error bars represent standard deviation. The data shown in FIGS. 20B and 20C are representative of experiments using PBMCs from two AGMs.

FIGS. 21A and 21B are results from the staining of surface OX40 and PD-1 on CD4+ and CD8+ T cells stimulated with plate-bound 0.8 μg/ml of an anti-CD3 antibody and 5 ng/ml of the anti-GITR antibody Hum231#2. FIG. 21A is a set of flow cytometry plots and histograms showing co-staining of OX40 and PD-1. In FIG. 21B, each bar represents the MFI value for PD-1 and OX40 on CD4+ and CD8+ T cells stimulated with Hum231#2 (black bars), isotype control (gray bars) or media only (white bars). The error bars represent standard deviation. The flow cytometry plots and graphs are representative of experiments using PBMCs from one donor.

FIGS. 22A and 22B show the design of the mutated libraries for the generation of germlined antibody variants. The different framework and CDR positions included in the library based on the IGHV1-2*02 VH human germline are shown in FIG. 22A (SEQ ID NOS 37-53, respectively, in order of appearance) and for the library based on the IGKV4-1*01 VL human germline in FIG. 22B (SEQ ID NOS 54-71, respectively, in order of appearance).

FIG. 23 is a table listing 17 germlined antibody variants and detailing their heavy and light chain variable regions with corresponding SEQ ID numbers. The table shows the number of extra germline amino acids and the mean relative affinity of the variant antibodies compared to the chimeric parental 231-32-15 antibody.

FIGS. 24A-C are a table listing 107 germlined antibody variants and detailing their heavy and light chain variable regions with corresponding SEQ ID numbers.

FIGS. 25A and 25B show GITRL-PE binding to GITR in the presence of a selection of anti-GITR germlined antibody variants. The percentage of GITRL-PE binding was measured by suspension array technology (Luminex® 200 system) in the presence of increasing antibody concentrations (12, 37, 111, 333, 1000, 3000 and 9000 ng/ml).

FIGS. 26A and 26B show the effect on cell proliferation (% CFSE Low) of the germlined antibody variants compared to the chimeric parental 231-32-15 antibody and the humanized variants Hum231#1 and Hum231#2 on enriched CD4 T cells from two buffy coats, BC4 (FIG. 26A) and BC9 (FIG. 26B). A suboptimal CD3 stimulation assay was performed using plate bound anti-CD3 antibody at 125 ng/ml with either plate bound or soluble isotype control. Anti-GITR antibodies were used at a concentration of 10 μg/ml.

FIGS. 27A and 27B show the effect on cytokine release of IFNγ and IL-10, respectively of the germlined antibody variants compared to the chimeric parental 231-32-15 antibody and the humanized variants Hum231#1 and Hum231#2 on enriched CD4 T cells from buffy coat BC4. A suboptimal CD3 stimulation assay was performed using plate bound anti-CD3 antibody at 125 ng/ml with either plate bound or soluble isotype control. Anti-GITR antibodies were used at a concentration of 10 μg/ml and the cytokine levels were measured in the culture supernatant.

FIGS. 28A and 28B show the effect on cytokine release of IFNγ and IL-10, respectively of the germlined antibody variants compared to the chimeric parental 231-32-15 antibody and the humanized variants Hum231#1 and Hum231#2 on enriched CD4 T cells from buffy coat BC9. A suboptimal CD3 stimulation assay was performed using plate bound anti-CD3 antibody at 125 ng/ml with either plate bound or soluble isotype control. Anti-GITR antibodies were used at a concentration of 10 μg/ml and the cytokine levels were measured in the culture supernatant.

FIGS. 29A and 29B show the percentage of IFNγ positive CD4+ T-cells (as measured by intracellular staining) of germlined antibody variants compared to the chimeric parental 231-32-15 antibody and the humanized variants Hum231#1 and Hum231#2 on enriched CD4 T cells from two buffy coats. FIG. 29A shows the results from buffy coat 13 (BC13) and FIG. 29B shows the results from buffy coat 18 (BC18).

FIGS. 30A-C are a set of graphs showing the results of a GITR NF-κB-luciferase reporter assay in the presence of 0.3 μg/ml anti-CD3 antibody. The anti-GITR antibodies tested in this assay were Hum231#2w and 20 germline variants: pab1964, pab1965, pab1966, pab1967, pab1968, pab1969, pab1970, pab1971, pab1972, pab1973, pab1975, pab1976, pab1977, pab1979, pab1980, pab1981, pab1983, pab2159, pab2160 and pab2161. In FIGS. 30A-C, the luciferase RLU at 18-hour post-stimulation was plotted for different anti-GITR antibody concentrations tested. The error bars represent standard deviation.

FIGS. 30D-F are a set of graphs showing the results of a GITR NF-κB-luciferase reporter assay in the absence of an anti-CD3 antibody. The anti-GITR antibodies tested in this assay were m6C8, Hum231#2w and 20 germline variants: pab1964, pab1965, pab1966, pab1967, pab1968, pab1969, pab1970, pab1971, pab1972, pab1973, pab1975, pab1976, pab1977, pab1979, pab1980, pab1981, pab1983, pab2159, pab2160 and pab2161. In FIGS. 30D-F, the luciferase RLU at 6-hour post-stimulation was plotted for different anti-GITR antibody concentrations tested. The error bars represent standard deviation. The graphs and plots are representative of data from two experiments (FIGS. 30A-C) or one experiment (FIGS. 30D-F).

FIG. 31 shows the loss of binding of 1624-5 pre-B cells expressing the chimeric parental 231-32-15 antibody to biotinylated GITR (GITR-bio) when GITR-bio was pre-incubated with chimeric parental 231-32-15, Hum231#1 or Hum231#2 antibodies. FIG. 31 right-hand profile depicts the binding of 1624-5 pre-B cells expressing the chimeric parental 231-32-15 antibody to GITR-bio. In the left-hand profile however, there is loss of binding of 1624-5 cells expressing the chimeric parental 231-32-15 antibody to GITR-bio following pre-incubation of GITR-bio with either the chimeric parental 231-32-15, Hum231#1 or Hum231#2 antibodies.

FIG. 32 shows the results of an epitope competition assay measured by surface plasmon resonance (BIAcore® T100/200). GITR antigen was immobilized on a CM5 sensor chip and the anti-GITR antibodies applied at a concentration of 300 nM. Chimeric parental 231-32-15 antibody was applied first followed by the application of the murine antibody 6C8.

FIGS. 33A and 33B are the results of an epitope mapping experiment using a cellular library expressing GITR variants generated by error prone PCR. Shown in FIGS. 33A and 33B is an alignment of sequences from the GITR variants that bind to a polyclonal anti-GITR antibody but do not bind to the anti-GITR chimeric parental 231-32-15 antibody.

FIGS. 34A and B are the result of an epitope mapping experiment using alanine scanning. The following positions in human GITR (numbered according to SEQ ID NO: 701) were separately mutated to an Alanine: P28A, T29A, G30A, G31A, P32A, T54A, T55A, R56A, C57A, C58A, R59A, D60A, Y61A, P62A, G63A, E64A, E65A, C66A, C67A, S68A, E69A, W70A, D71A, C72A, M73A, C74A, V75A and Q76A. The antibodies tested in the experiment shown in FIG. 34A included: the monoclonal anti-GITR antibodies Hum231#2, three germline variants (pab1967, pab1975 and pab1979) and the m6C8 antibody; and a polyclonal anti-GITR antibody (AF689, R&D systems). FIG. 34A is a table summarizing the binding of Hum231#2, three germline variants (pab1967, pab1975 and pab1979) and the reference antibody m6C8 to 1624-5 cells expressing human GITR alanine mutants. FIG. 34B is a set of flow cytometry plots showing the staining of 1624-5 cells expressing wild type human GITR, D60A mutant, or G63A mutant using the monoclonal antibodies 231-32-15, Hum231#2, or m6C8, or a polyclonal antibody. The percentage of GITR positive cells is indicated in each plot.

FIG. 35A is a sequence alignment of human GITR, V1M cynomolgus GITR, and V1M/Q62P/S63G cynomolgus GITR, highlighting the positions 62 and 63 where two amino acids from cynomolgus GITR (GlnSer) were replaced by corresponding residues in human GITR (ProGly).

FIG. 35B is a set of flow cytometry plots showing the staining of 1624-5 cells expressing human GITR, V1M cynomolgus GITR, or V1M/Q62P/S63G cynomolgus GITR using the monoclonal antibodies 231-32-15, Hum231#2, or m6C8, or a polyclonal anti-GITR antibody.

5. DETAILED DESCRIPTION

Figure 1:
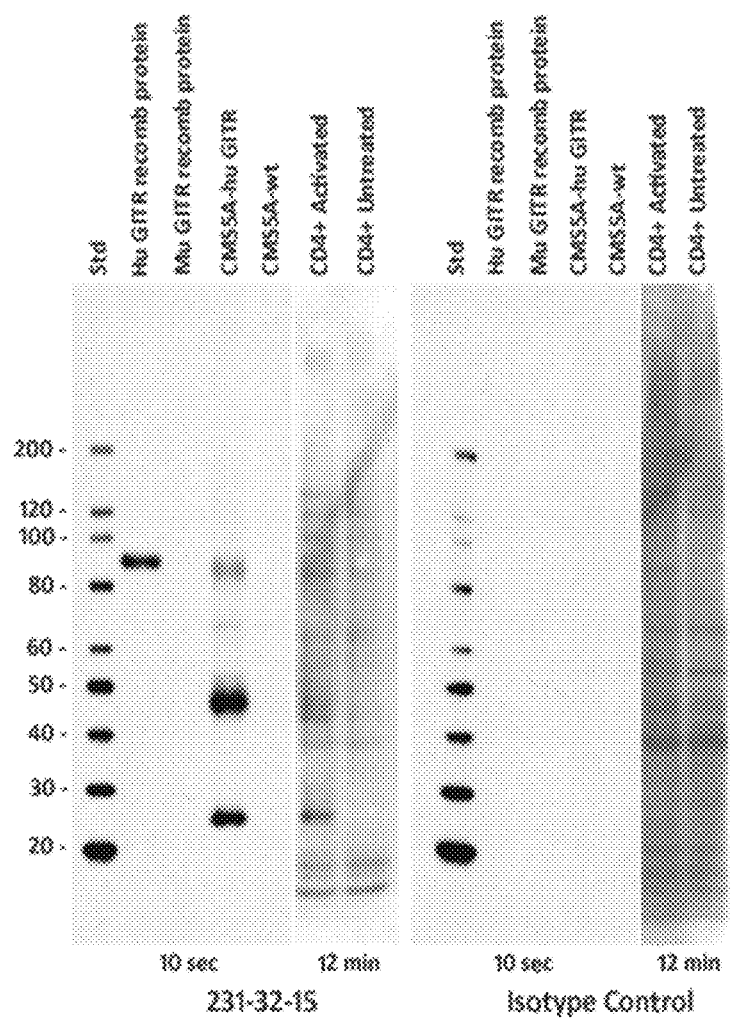

Provided herein are antibodies (e.g., monoclonal antibodies), and antigen-binding fragments thereof, that specifically bind to GITR (e.g., human GITR) and modulate GITR activity. For example, in one aspect, provided herein is an antibody(ies) or fragment(s) thereof that specifically binds to GITR and enhances, induces, or increases one or more GITR activities. In a specific embodiment, the antibody(ies) or antigen-binding fragment(s) is isolated.

Also provided are isolated nucleic acids (polynucleotides), such as complementary DNA (cDNA), encoding such antibodies, and antigen-binding fragments thereof. Further provided are vectors (e.g., expression vectors) and cells (e.g., host cells) comprising nucleic acids (polynucleotides) encoding such antibodies or antigen-binding fragments thereof. Also provided are methods of making such antibodies. In other aspects, provided herein are methods and uses for inducing, increasing or enhancing a GITR activity, and treating certain conditions, such as cancer and infectious diseases. Related compositions (e.g., pharmaceutical compositions), kits, and detection methods are also provided.

5.1 Antibodies

In a specific aspect, provided herein are antibodies (e.g., monoclonal antibodies, such as chimeric or humanized antibodies) and fragments thereof which specifically bind to GITR (e.g., human GITR). In some embodiments, an antibody or antigen-binding fragment thereof described herein partially inhibits GITRL (e.g., human GITRL) from binding to GITR (e.g., human GITR). In certain embodiments, an antibody or antigen-binding fragment thereof described herein inhibits binding of GITRL (e.g., human GITRL) to GITR (e.g., human GITR) by less than 85%, 80%, 75%, 70%, 65%, 60%, 55%, 50%, 45%, 40%, 35%, 30%, 25%, 20% or 10% as assessed by an assay known to one of skill in the art or described herein. In a specific embodiment, an antibody or antigen-binding fragment thereof described herein inhibits binding of GITRL (e.g., human GITRL) to GITR (e.g., human GITR) by less than 85%, 80%, 75%, 70%, 65%, 60%, 55%, 50%, 45%, 40%, 35%, 30%, 25%, 20% or 10% as assessed by the assay described in Example 2, infra (e.g., Sections 6.2.5.2 or 6.2.5.4, infra). In another specific embodiment, an antibody or antigen-binding fragment thereof described herein at a concentration of 1000 ng/ml, 950 ng/ml, 900 ng/ml, 850 ng/ml, 800 ng/ml, 750 ng/ml, 700 ng/ml, 650 ng/ml, 600 ng/ml, 550 ng/ml, 500 ng/ml, 450 ng/ml, 400 ng/ml, 350 ng/ml, 333 ng/ml, 300 ng/ml, 250 ng/ml, 200 ng/ml, 100 ng/ml, 50 ng/ml or 10 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, an antibody or antigen-binding fragment thereof described herein at concentration of 1000 ng/ml to 750 ng/ml, 1000 ng/ml to 500 ng/ml, 850 ng/ml to 500 ng/ml, 750 ng/ml to 500 ng/ml, 600 ng/ml to 500 ng/ml, 500 ng/ml to 400 ng/ml, 400 ng/ml to 300 ng/ml, or 300 ng/ml to 200 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM, 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, an antibody or antigen-binding fragment thereof at a concentration of 1000 ng/ml inhibits less than 80% (in some embodiments, 40% to 70%, 50%, to 80%, or 40% to 80%) of 0.5 nM labeled GITRL (e.g., human GITRL) from binding to GITR coupled to beads (e.g., human GITR coupled to Luminex® beads) at a concentration of 5 pg/ml/bead relative to the binding of 0.5 nM of labeled GITRL to GITR coupled beads at a concentration of 5 pg/ml/bead in the absence of the anti-GITR antibody or antigen-binding fragment thereof in a suspension array assay.

In another specific embodiment, an antibody or antigen-binding fragment thereof described herein at concentration of 3500 ng/ml, 3400 ng/ml, 3300 ng/ml, 3200 ng/ml, 3100 ng/ml, 3000 ng/ml, 2900 ng/ml, 2800 ng/ml, 2700 ng/ml, 2600 ng/ml, 2500 ng/ml, 2400 ng/ml, 2300 ng/ml, 2200 ng/ml, 2100 ng/ml, 2000 ng/ml, 1900 ng/ml, 1800 ng/ml, 1700 ng/ml, 1600 ng/ml, 1500 ng/ml, 1400 ng/ml, 1300 ng/ml, 1200 ng/ml, or 1100 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, an antibody or antigen-binding fragment thereof described herein at concentration of 3500 ng/ml to 3200 ng/ml, 3500 ng/ml to 3000 ng/ml, 3200 ng/ml to 2500 ng/ml, 3000 to 2200 ng/ml, 2500 ng/ml to 1800 ng/ml, 2000 ng/ml to 1500 ng/ml, 1700 ng/ml to 1200 ng/ml, or 1500 ng/ml to 1000 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system).

In a certain embodiment, an antibody or antigen-binding fragment thereof described herein at a concentration of 3000 ng/ml inhibits binding of 0.5 nM GITRL (e.g., human GITRL) to GITR (e.g., human GITR) by less than 85% or less than 80% (in some embodiments, 60% to 85%, 60% to 80%, 70% to 85% or 70% to 80%) when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 1000 ng/ml inhibits binding of 0.5 nM GITRL (e.g., human GITRL) to GITR (e.g., human GITR) by less than 85%, less than 80% or less than 75% (in some embodiments, 60% to 85%, 60% to 80%, 70% to 85% or 70% to 80%) when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 333 ng/ml inhibits binding of 0.5 nM GITRL (e.g., human GITRL) to GITR (e.g., human GITR) by less than 70% or less than 65% (in some embodiments, 50% to 70%, 55% to 70%, 50% to 65% or 50% to 60%) when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 111 ng/ml inhibits binding of 0.5 nM GITRL (e.g., human GITRL) to GITR (e.g., human GITR) by less than 65%, less than 60% or less than 55% (in some embodiments, 40% to 65%, 40% to 60%, 40% to 55% or 30% to 60%) when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 37 ng/ml inhibits binding of 0.5 nM GITRL (e.g., human GITRL) to GITR (e.g., human GITR) by less than 40% (in some embodiments, 20% to 40%, 20% to 30%, or 15% to 35%) when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 12 ng/ml inhibits binding of 0.5 nM GITRL (e.g., human GITRL) to GITR (e.g., human GITR) by less than 20% (in some embodiments, 10% to 20%) when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system).

In certain embodiments, at least 10%, 15%, 20%, 25%, 30%, 35%, 40%, 45%, 50%, 55%, 60%, 65%, 70%, or 75% of GITRL (e.g., human GITRL) binds to GITR (e.g., human GITR) in the presence of an antibody or antigen-binding fragment thereof described herein assessed by an assay known to one of skill in the art or described herein. In a specific embodiment, at least 10%, 15%, 20%, 25%, 30%, 35%, 40%, 45%, 50%, 55%, 60%, 65%, 70%, or 75% of GITRL (e.g., human GITRL) binds to GITR (e.g., human GITR) in the presence of an antibody or antigen-binding fragment thereof described herein as assessed by the assay described in Example 2, infra (e.g., Section 6.2.5.2 or 6.2.5.4, infra). In another specific embodiment, at least 10%, 15%, 20%, 25%, 30%, 35%, 40%, 45%, 50%, 55%, 60%, 65%, 70%, or 75% of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., labeled human GITRL, such as hGITRL-PE) binds to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead in the presence of 1000 ng/ml, 950 ng/ml, 900 ng/ml, 850 ng/ml, 800 ng/ml, 750 ng/ml, 700 ng/ml, 650 ng/ml, 600 ng/ml, 550 ng/ml, 500 ng/ml, 450 ng/ml, 400 ng/ml, 350 ng/ml, 333 ng/ml, 300 ng/ml, 250 ng/ml or 200 ng/ml of an antibody or antigen-binding fragment thereof described herein relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, at least 10%, 15%, 20%, 25%, 30%, 35%, 40%, 45%, 50%, 55%, 60%, 65%, 70%, or 75% of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., labeled human GITRL, such as hGITRL-PE) binds to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead in the presence of 1000 ng/ml to 900 ng/ml, 1000 ng/ml to 850 ng/ml, 900 ng/ml to 800 ng/ml, or 850 ng/ml to 750 ng/ml, or 800 to 750 ng/ml relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, at least 20%, at least 25% or at least 30% of 0.5 nM of labeled GITRL (e.g., labeled human GITRL, such as hGITRL-PE) binds to GITR coupled to beads (e.g., human GITR coupled to Luminex® beads) at a concentration of 5 pg/ml/bead in the presence of 1000 ng/ml of an antibody or antigen-binding fragment thereof relative to the binding of 0.5 nM of labeled GITRL to GITR coupled beads at a concentration of 5 pg/ml/bead in the absence of the anti-GITR antibody or antigen-binding fragment thereof in a suspension array assay.

In another specific embodiment, at least 10%, 15%, 20%, 25%, 30%, 35%, 40%, 45%, 50%, 55%, 60%, 65%, 70%, or 75% of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM, 0.1 nM of labeled GITRL (e.g., labeled human GITRL, such as hGITRL-PE) binds to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead in the presence of 3500 ng/ml, 3400 ng/ml, 3300 ng/ml, 3200 ng/ml, 3100 ng/ml, 3000 ng/ml, 2900 ng/ml, 2800 ng/ml, 2700 ng/ml, 2600 ng/ml, 2500 ng/ml, 2400 ng/ml, 2300 ng/ml, 2200 ng/ml, 2100 ng/ml, 2000 ng/ml, 1900 ng/ml, 1800 ng/ml, 1700 ng/ml, 1600 ng/ml, 1500 ng/ml, 1400 ng/ml, 1300 ng/ml, 1200 ng/ml, 1100 ng/ml or 1000 ng/ml of an antibody or antigen-binding fragment thereof described herein relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, at least 10%, 15%, 20%, 25%, 30%, 35%, 40%, 45%, 50%, 55%, 60%, 65%, 70%, or 75% of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., labeled human GITRL, such as hGITRL-PE) binds to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead in the presence of 3500 ng/ml to 3200 ng/ml, 3500 ng/ml to 3000 ng/ml, 3200 ng/ml to 2500 ng/ml, 3000 to 2200 ng/ml, 2500 ng/ml to 1800 ng/ml, 2000 ng/ml to 1500 ng/ml, 1700 ng/ml to 1200 ng/ml, or 1500 ng/ml to 1000 ng/ml of an antibody or antigen-binding fragment thereof described herein relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system).

In another specific embodiment, at least 20%, at least 25% or at least 30% of 0.5 nM of labeled GITRL (e.g., labeled human GITRL, such as hGITRL-PE) binds to GITR coupled to beads (e.g., human GITR coupled to Luminex® beads) at a concentration of 5 pg/ml/bead in the presence of 3000 ng/ml of an antibody or antigen-binding fragment thereof relative to the binding of 0.5 nM of labeled GITRL to GITR coupled beads at a concentration of 5 pg/ml/bead in the absence of the anti-GITR antibody or antigen-binding fragment thereof in a suspension array assay. In another specific embodiment, at least 25%, at least 30%, at least 40%, or at least 50% (in some embodiments, 25% to 60%, 40% to 60%, 40% to 70%, or 25% to 50%) of 0.5 nM of labeled GITRL (e.g., labeled human GITRL, such as hGITRL-PE) binds to GITR coupled to beads (e.g., human GITR coupled to Luminex® beads) at a concentration of 5 pg/ml/bead in the presence of 1000 ng/ml of an antibody or antigen-binding fragment thereof relative to the binding of 0.5 nM of labeled GITRL to GITR coupled beads at a concentration of 5 pg/ml/bead in the absence of the anti-GITR antibody or antigen-binding fragment thereof in a suspension array assay. In another specific embodiment, at least 30%, at least 40%, at least 50% or at least 60% (in some embodiments, 30% to 60%, 40% to 60%, 40% to 70%, or 30% to 50%) of 0.5 nM of labeled GITRL (e.g., labeled human GITRL, such as hGITRL-PE) binds to GITR coupled to beads (e.g., human GITR coupled to Luminex® beads) at a concentration of 5 pg/ml/bead in the presence of 333 ng/ml of an antibody or antigen-binding fragment thereof relative to the binding of 0.5 nM of labeled GITRL to GITR coupled beads at a concentration of 5 pg/ml/bead in the absence of the anti-GITR antibody or antigen-binding fragment thereof in a suspension array assay. In another specific embodiment, at least 40%, at least 50%, at least 60% or at least 65% (in some embodiments, 40% to 70%, 40% to 60%, 40% to 65%, or 40% to 50%) of 0.5 nM of labeled GITRL (e.g., labeled human GITRL, such as hGITRL-PE) binds to GITR coupled to beads (e.g., human GITR coupled to Luminex® beads) at a concentration of 5 pg/ml/bead in the presence of 111 ng/ml of an antibody or antigen-binding fragment thereof relative to the binding of 0.5 nM of labeled GITRL to GITR coupled beads at a concentration of 5 pg/ml/bead in the absence of the anti-GITR antibody or antigen-binding fragment thereof in a suspension array assay. In another specific embodiment, at least 60%, at least 70% or at least 80% (in some embodiments 60% to 80%, 70% to 80% or 75% to 85%) of 0.5 nM of labeled GITRL (e.g., labeled human GITRL, such as hGITRL-PE) binds to GITR coupled to beads (e.g., human GITR coupled to Luminex® beads) at a concentration of 5 pg/ml/bead in the presence of 37 ng/ml of an antibody or antigen-binding fragment thereof relative to the binding of 0.5 nM of labeled GITRL to GITR coupled beads at a concentration of 5 pg/ml/bead in the absence of the anti-GITR antibody or antigen-binding fragment thereof in a suspension array assay. In another specific embodiment, at least 80%, at least 85% or at least 90% (in some embodiments 80% to 90% or 85% to 95%) of 0.5 nM of labeled GITRL (e.g., labeled human GITRL, such as hGITRL-PE) binds to GITR coupled to beads (e.g., human GITR coupled to Luminex® beads) at a concentration of 5 pg/ml/bead in the presence of 12 ng/ml of an antibody or antigen-binding fragment thereof relative to the binding of 0.5 nM of labeled GITRL to GITR coupled beads at a concentration of 5 pg/ml/bead in the absence of the anti-GITR antibody or antigen-binding fragment thereof in a suspension array assay In a certain embodiment, an antibody or antigen-binding fragment thereof described herein at a concentration of 3000 ng/ml does not inhibit binding of 0.5 nM GITRL (e.g., human GITRL) to GITR (e.g., human GITR) by more than 15% or more than 20% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 1000 ng/ml does not inhibit binding of 0.5 nM GITRL (e.g., human GITRL) to GITR (e.g., human GITR) by more than 15%, more than 20% or more than 25% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 333 ng/ml does not inhibit binding of 0.5 nM GITRL (e.g., human GITRL) to GITR (e.g., human GITR) by more than 30% or more than 35% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 111 ng/ml does not inhibit binding of 0.5 nM GITRL (e.g., human GITRL) to GITR (e.g., human GITR) by more than 35%, more than 40% or more than 45% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 37 ng/ml does not inhibit binding of 0.5 nM GITRL (e.g., human GITRL) to GITR (e.g., human GITR) by more than 60% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system). In a certain embodiment, an antibody or antigen-binding fragment thereof described herein at a concentration of 12 ng/ml does not inhibit binding of 0.5 nM GITRL (e.g., human GITRL) to GITR (e.g., human GITR) by more than 80% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof, in a suspension array assay (e.g., Luminex® 200 system).

In another embodiment, a certain amount of labeled GITRL (e.g., human GITRL-PE) binds to GITR coupled to beads (e.g., human GITR coupled to Luminex® beads) in the presence of an antibody or antigen-binding fragment thereof described herein in a method comprising: (a) coupling GITR (e.g., human GITR) to beads at a concentration of approximately 9 pg/ml, 8 pg/ml, 7 pg/ml, 6 pg/ml, 5 pg/ml, 4 pg/ml or 3 pg/ml per bead; (b) incubating the GITR coupled beads at a concentration of approximately 30 beads/µl, 40 beads/µl, or 50 beads/µl with 3000 ng/ml, 2500 ng/ml, 2000 ng/ml, 1500 ng/ml, 1000 ng/ml, 750 ng/ml, 500 ng/ml, 250 ng/ml, 100 ng/ml, 50 ng/ml, 25 ng/ml or 10 ng/ml of an antibody or an antigen-binding fragment thereof described herein in a well for a first period of time (e.g., 30 minutes, 60 minutes, 1.5 hours, 2 hours, 2.5 hours or 3 hours); (c) adding labeled GITRL (e.g., human GITRL-PE) to the well to obtain a final concentration of approximately 1.5 nM, 1 nM, 0.9 nM, 0.8 nM, 0.7 nM, 0.6 nM, 0.5 nM, 0.4 nM, 0.3 nM, 0.2 nM or 0.1 nM of the labeled GITRL and approximately 15 beads/µl, 20 beads/µl, or 25 beads/µl, and incubating for a second period of time (e.g., 30 minutes, 1 hour, 1.5 hours, 2 hours, 2.5 hours or 3 hours); and (d) detecting the labeled GITRL bound to the GITR coupled beads in, e.g., a suspension array assay such as the Luminex® 200 system. In specific embodiments, the amount of the labeled GITRL bound to the GITR coupled beads in the presence of the anti-GITR antibody or antigen-binding fragment thereof is determined relative to the amount of labeled GITRL bound to the GITR coupled beads in the absence of the anti-GITR antibody or antigen-binding fragment thereof. In certain embodiments, the absence of the anti-GITR antibody or antigen-binding fragment thereof means that no antibody or antigen-binding fragment thereof is present in the well. In other embodiments, the absence of the anti-GITR antibody or antigen-binding fragment thereof means that an isotype control antibody that does not bind to GITR is present in the well. In accordance with these embodiments, the amount of labeled GITRL bound to the GITR coupled beads in the presence of the anti-GITR antibody or antigen-binding fragment thereof is determined to be, in some embodiments, at least 15%, 20%, 25%, 30%, 35%, 40%, 45%, 50%, 55% or 60% or 15% to 60%, 20% to 60%, 30% to 70%, or 20% to 50% of the amount of the labeled GITRL bound to the GITR coupled beads in the absence of the anti-GITR antibody or antigen-binding fragment thereof In another embodiment, a certain amount of labeled GITRL (e.g., human GITRL-PE) binds to GITR coupled to beads (e.g., human GITR coupled to Luminex® beads) in the presence of an antibody or antigen-binding fragment thereof described herein in a method comprising: (a) coupling GITR (e.g., human GITR) to beads at a concentration of approximately 5 pg/ml per bead; (b) incubating the GITR coupled beads at a concentration of approximately 40 beads/µl with 3000 ng/ml, 2500 ng/ml, 2000 ng/ml, 1500 ng/ml, 1000 ng/ml, 750 ng/ml, 500 ng/ml, 250 ng/ml, 100 ng/ml, 50 ng/ml or 10 ng/ml of an antibody or an antigen-binding fragment thereof described herein in a well for a first period of time (e.g., 30 minutes, 60 minutes, 1.5 hours, 2 hours, 2.5 hours or 3 hours); (c) adding labeled GITRL (e.g., human GITRL-PE) to the well to obtain a final concentration of 0.5 nM of the labeled GITRL and approximately 20 beads/µl, and incubating for a second period of time (e.g., 30 minutes, 1 hour, 1.5 hours, 2 hours, 2.5 hours or 3 hours); and (d) detecting the labeled GITRL bound to the GITR coupled beads in, e.g., a suspension array assay such as the Luminex® 200 system. In specific embodiments, the amount of the labeled GITRL bound to the GITR coupled beads in the presence of the anti-GITR antibody or antigen-binding fragment thereof is determined relative to the amount of labeled GITRL bound to the GITR coupled beads in the absence of the anti-GITR antibody or antigen-binding fragment thereof. In certain embodiments, the absence of the anti-GITR antibody or antigen-binding fragment thereof means that no antibody or antigen-binding fragment thereof is present in the well. In other embodiments, the absence of the anti-GITR antibody or antigen-binding fragment thereof means that an isotype control antibody that does not bind to GITR is present in the well. In accordance with these embodiments, the amount of labeled GITRL bound to the GITR coupled beads in the presence of the anti-GITR antibody or antigen-binding fragment thereof is determined to be, in some embodiments, at least 20%, 25%, 30%, 35%, 40%, 45%, 50%, 55% or 60% or 20 to 70%, 20% to 60%, 30% to 70%, or 20% to 50% of the amount of the labeled GITRL bound to the GITR coupled beads in the absence of the anti-GITR antibody or antigen-binding fragment thereof.

In certain embodiments, an antibody or antigen-binding fragment thereof described herein at a concentration of 150 nM, 145 nM, 140 nM, 135 nM, 130 nM, 125 nM, 120 nM, 115 nM, 110 nM, 105 nM or 100 nM bound to GITR (e.g., human GITR) immobilized on a chip (e.g., CM5 sensor chip) inhibits binding of 150 nM, 145 nM, 140 nM, 135 nM, 130 nM, 125 nM, 120 nM, 115 nM, 110 nM, 105 nM or 100 nM of GITRL (e.g., non-covalently linked trimer of human GITRL) to the GITR immobilized on the chip by less than 60%, less than 55%, less than 50%, less than 45%, less than 40%, less than 35%, less than 30%, less than 25%, less than 20% or less than 15%. In certain embodiments, an antibody or antigen-binding fragment thereof described herein at a concentration of 125 nM bound to GITR (e.g., human GITR) immobilized on a chip (e.g., CM5 sensor chip) inhibits binding of 125 nM of GITRL (e.g., non-covalently linked trimer of human GITRL) to the GITR immobilized on the chip by less than 60%, less than 55%, less than 50%, less than 45%, less than 40%, less than 35%, less than 30%, less than 25%, less than 20% or less than 15%.

In certain embodiments, an antibody or fragment thereof described herein binds to GITR (e.g., human GITR) with a dissociation rate constant ($k_{off}$) of $8.5 \times 10^{-3}$ $s^{-1}$ or less, $3.5 \times 10^{-3}$ $s^{-1}$ or less, $5 \times 10^{-3}$ $s^{-1}$ or less, $2.5 \times 10^{-3}$ $s^{-1}$ or less, $1 \times 10^{-3}$ $s^{-1}$ or less, $8.5 \times 10^{-4}$ $s^{-1}$ or less, $5 \times 10^{-4}$ $s^{-1}$ or less, $3.5 \times 10^{-4}$ $s^{-1}$ or less, $2.5 \times 10^{-4}$ $s^{-1}$ or less, $1 \times 10^{-4}$ $s^{-1}$ or less, $8.5 \times 10^{-5}$ $s^{-1}$ or less, $3.5 \times 10^{-5}$ $s^{-1}$ or less, $5 \times 10^{-5}$ $s^{-1}$ or less, $2.5 \times 10^{-5}$ $s^{-1}$ or less, $1 \times 10^{-5}$ $s^{-1}$ or less, $8.5 \times 10^{-6}$ $s^{-1}$ or less, $5 \times 10^{-6}$ $s^{-1}$ or less, $3.5 \times 10^{-6}$ $s^{-1}$ or less, $2.5 \times 10^{-6}$ $s^{-1}$ or less, $1 \times 10^{-6}$ $s^{-1}$ or less, $8.5 \times 10^{-7}$ $s^{-1}$ or less, $5 \times 10^{-7}$ $s^{-1}$ or less, $2.5 \times 10^{-7}$ $s^{-1}$ or less, $1 \times 10^{-7}$ $s^{-1}$ or less, $8.5 \times 10^{-8}$ $s^{-1}$ or less, $5 \times 10^{-8}$ $s^{-1}$ or less, $2.5 \times 10^{-8}$ $s^{-1}$ or less, $1 \times 10^{-8}$ $s^{-1}$ or less, $8.5 \times 10^{-9}$ $s^{-1}$ or less, $5 \times 10^{-9}$ $s^{-1}$ or less, $2.5 \times 10^{-9}$ $s^{-1}$ or less, or $1 \times 10^{-9}$ $s^{-1}$ or less. In some embodiments, an antibody or fragment thereof described herein binds to GITR (e.g., human GITR) with a $k_{off}$ of between $9.5 \times 10^{-5}$ $s^{-1}$ to $1 \times 10^{-9}$ $s^{-1}$, $8.5 \times 10^{-5}$ $s^{-1}$ to $1 \times 10^{-9}$ $s^{-1}$, $5 \times 10^{-5}$ $s^{-1}$ to $1 \times 10^{-9}$ $s^{-1}$, $9.5 \times 10^{-5}$ $s^{-1}$ to $1 \times 10^{-8}$ $s^{-1}$, $5 \times 10^{-5}$ $s^{-1}$ to $1 \times 10^{-5}$ $s^{-1}$, $9.5 \times 10^{-5}$ $s^{-1}$ to $1 \times 10^{-7}$ $s^{-1}$, $5 \times 10^{-5}$ $s^{-1}$ to $1 \times 10^{-7}$ $s^{-1}$, $9.5 \times 10^{-5}$ $s^{-1}$ to $5 \times 10^{-6}$ $s^{-1}$, $9.5 \times 10^{-5}$ $s^{-1}$ to $1 \times 10^{-5}$ $s^{-1}$, $8.5 \times 10^{-3}$ $s^{-1}$ to $1 \times 10^{-4}$ $s^{-1}$, $5 \times 10^{-3}$ $s^{-1}$ to $2.5 \times 10^{-4}$ $s^{-1}$, $8.5 \times 10^{-3}$ $s^{-1}$, to $1 \times 10^{-5}$ $s^{-1}$, $8.5 \times 10^{-5}$ $s^{-1}$ to $5 \times 10^{-5}$ $s^{-1}$. In certain embodiments, the $k_{off}$ is determined using a monovalent antibody, such as a Fab fragment, as measured by, e.g., BIAcore® surface plasmon resonance technology. In other embodiments, the $k_{off}$ is determined using a bivalent antibody as measured by, e.g., BIAcore® surface plasmon resonance technology. In a particular embodiment, the $k_{off}$ is determined using an assay described in Section 6, infra.

In certain embodiments, an antibody or fragment thereof described herein binds to GITR (e.g., human GITR) with an association rate constant ($k_{on}$) of at least $10^5$ $M^{-1}$ $s^{-1}$, at least $2.5 \times 10^5$ $M^{-1}s^{-1}$, at least $3.5 \times 10^5$ $M^{-1}s^{-1}$, at least $5 \times 10^5$ $M^{-1}s^{-1}$, at least $10^6$ $M^{-1}s^{-1}$, at least $2.5 \times 10^6$ $M^{-1}s^{-1}$, at least $3.5 \times 10^6$ $M^{-1}s^{-1}$, at least $5 \times 10^6$ $M^{-1}s^{-1}$, at least $10^7$ $M^{-1}s^{-1}$, at least $5 \times 10^7$ $M^{-1}s^{-1}$, at least $10^8$ $M^{-1}s^{-1}$, at least $5 \: 10^8$ $M^{-1}s^{-1}$ or at least $10^9$ $M^{-1}s^{-1}$. In some embodiments, an antibody or fragment thereof described herein binds to GITR (e.g., human GITR) with a $k_{on}$ of between $1 \times 10^5$ $M^{-1}s^{-1}$ to $5 \times 10^5$ $M^{-1}s^{-1}$, $1 \times 10^5$ $M^{-1}$ $s^{-1}$ to $1 \times 10^6$ $M^{-1}$ $s^{-1}$, $3.5 \times 10^5$ $M^{-1}s^{-1}$ to $2.5 \times 10^6$ $M^{-1}$ $s^{-1}$, $3.5 \times 10^5$ $M^{-1}$ $s^{-1}$ to $3.5 \times 10^6$ $M^{-1}$ $s^{-1}$, $1 \times 10^5$ $M^{-1}s^{-1}$ to $5 \times 10^6$ $M^{-1}$ $s^{-1}$, $1 \times 10^5$ $M^{-1}$ $s^{-1}$ to $1 \times 10^7$ $M^{-1}s^{-1}$, $1 \times 10^5$ $M^{-1}$ $s^{-1}$ to $5 \times 10^7$ $M^{-1}s^{-1}$, $1 \times 10^5$ $M^{-1}$ $s^{-1}$ to $10^8$ $M^{-1}s^{-1}$, $1 \times 10^5$ $M^{-1}s^{-1}$ to $1 \times 10^9$ $M^{-1}s^{-1}$, $1 \times 10^6$ $M^{-1}$ $s^{-1}$ to $1 \times 10^7$ $M^{-1}s^{-1}$, $1 \times 10^6$ $M^{-1}$ $s^{-1}$ to $1 \times 10^8 M^{-1}s^{-1}$, $1 \times 10^6$ $M^{-1}s^{-1}$ to $1 \times 10^9$ $M^{-1}$ $s^{-1}$, $1 \times 10^7$ $M^{-1}s^{-1}$ to $1 \times 10^8$ $M^{-1}$ $s^{-1}$, $1 \times 10^7$ $M^{-1}s^{-1}$ to $1 \times 10^9$ $M^{-1}s^{-1}$, $1 \times 10^8$ $M^{-1}s^{-1}$ to $1 \times 10^9$ $M^{-1}s^{-1}$. In certain embodiments, the $k_{on}$ is determined using a monovalent antibody, such as a Fab fragment, as measured by, e.g., BIAcore® surface plasmon resonance technology. In other embodiments, the $k_{on}$ is determined using a bivalent antibody as measured by, e.g., BIAcore® surface plasmon resonance technology. In a particular embodiment, the $k_{on}$ is determined using an assay described in Section 6, infra.

In certain embodiments, an antibody or fragment thereof described herein binds to GITR (e.g., human GITR) with a $K_D$ of less than 7 nM, 6 nM, 5 nM, 4.5 nM, 4 nM, 3.5 nM, 3 nM, 2.5 nM, 2 nM, 1.5 nM, 1 nM, 0.75 nM, 0.5 nM, 0.25 nM, or 0.1 nM. In some embodiments, an antibody or fragment thereof described herein binds to GITR (e.g., human GITR) with a $K_D$ of about 7 nM, 6 nM, 5 nM, 4.5 nM, 4 nM, 3.5 nM, 3 nM, 2.5 nM, 2 nM, 1.5 nM, 1 nM, 0.75 nM, 0.5 nM, 0.25 nM, or 0.1 nM. In certain embodiments, an antibody or fragment thereof described herein binds to GITR (e.g., human GITR) with a $K_D$ of 7 nM to 2 nM, 5 nM to 3 nM, 5 nM to 1 nM, 4 nM to 3 nM, 4 nM to 2 nM, 3 nM to 2 nM, 3 nM to 1 nM, 2 nM to 1 nM, 3 nM to 0.1 nM, 2 nM to 0.1 nM, 1 nM to 0.1 nM, or 0.5 nM to 0.1 nM. In certain embodiments, the $K_D$ is calculated as the quotient of $k_{off}/k_{on}$, and the $k_{on}$ and $k_{off}$ are determined using a monovalent antibody, such as a Fab fragment, as measured by, e.g., BIAcore® surface plasmon resonance technology. In other embodiments, the $K_D$ is calculated as the quotient of $k_{off}/k_{on}$, and the $k_{on}$ and $k_{off}$ are determined using a bivalent antibody, such as a Fab fragment, as measured by, e.g., BIAcore® surface plasmon resonance technology. In a specific embodiment, the $K_D$ is determined as set forth in the Examples in Section 6, infra (e.g., Example 2).

In a particular embodiment, an antibody or fragment thereof described herein, which specifically binds to GITR (e.g., human GITR), comprises a light chain variable region (VL) comprising:

(a) a VL CDR1 comprising, consisting of, or consisting essentially of the amino acid sequence KSSQSX$_1$X$_2$X$_3$X$_4$X$_5$X$_6$X$_7$KX$_8$YLX$_9$ (SEQ ID NO: 4), wherein:

X$_1$ is L, A, V, I, P, F or M
X$_2$ is L, A, V, I, P, F, M or S
X$_3$ is N, G, Q, S, T, C, W, Y or A
X$_4$ is S, G, N, Q, T, C, W, Y or A
X$_5$ is G, N, Q, S, T, C, W, Y or A
X$_6$ is N, G, Q, S, T, C, W, Y or A
X$_7$ is Q, G, N, S, T, C, W, Y or A

X$_8$ is N, G, Q, S, T, C, W, Y or A
X$_9$ is T, G, N, Q, S, C, W, Y, V, I or A; and/or
(b) a VL CDR2 comprising, consisting of, or consisting essentially of the amino acid sequence X$_1$ASTRX$_2$X$_3$ (SEQ ID NO: 5), wherein:
X$_1$ is W, G, N, Q, S, T, C, Y, F, H or A
X$_2$ is E, D or A
X$_3$ is S, G, N, Q, T, C, Y or A; and/or
(c) a VL CDR3 comprising, consisting of, or consisting essentially of the amino acid sequence QX$_1$X$_2$YX$_3$X$_4$PYT (SEQ ID NO: 6), wherein:
X$_1$ is N, G, Q, S, T, C, W or Y
X$_2$ is D, E or Y
X$_3$ is S, G, N, Q, T, C, W, Y or A
X$_4$ is Y, G, N, Q, S, T, C, W, F, H, L, or A.

In specific embodiments, the antibody or antigen-binding fragment thereof comprises one, two, or all three of the VL CDRs above. In certain embodiments, the antibody or antigen-binding fragment thereof comprises the VL CDR1 of one of the antibodies in Table 1. In some embodiments, the antibody or antigen-binding fragment thereof comprises the VL CDR2 of one of the antibodies in Table 1. In certain embodiments, the antibody or antigen-binding fragment thereof comprises the VL CDR3 of one of the antibodies in Table 1. In certain embodiments, the antibody or antigen-binding fragment thereof comprises one, two or all three of the VL CDRs of one of the antibodies in Table 1 (e.g., the VL CDRs in one row of Table 1, for example, all of the VL CDRs are from antibody 231-32-15). In some embodiments, the antibody or antigen-binding fragment thereof comprises the VL framework regions described herein. In specific embodiments, the antibody or antigen-binding fragment thereof comprises the VL framework regions (FRs) of an antibody set forth in Table 3 (e.g., one, two, three, or four of the framework regions in one row of Table 3).

In another embodiment, an antibody described herein, or an antigen-binding fragment thereof, which specifically binds to GITR (e.g., human GITR), comprises a heavy chain variable region (VH) comprising:
(a) a VH CDR1 comprising, consisting of, or consisting essentially of the amino acid sequence X$_1$YX$_2$MX$_3$ (SEQ ID NO: 1), wherein
X$_1$ is D, E, G or A
X$_2$ is A, V, L, I, P, F, M or Y
X$_3$ is Y, G, N, Q, S, T, C, W, F or H; and/or
(b) a VH CDR2 comprising, consisting of, or consisting essentially of the amino acid sequence X$_1$IX$_2$X$_3$X$_4$SGX$_5$X$_6$X$_7$YX$_8$QKFX$_9$X$_{10}$ (SEQ ID NO: 2), wherein
X$_1$ is V, A, L, I, P, F, M or T
X$_2$ is R, K, H, Q or A
X$_3$ is T, G, N, Q, S, C, W, Y, V, I or P
X$_4$ is Y, G, N, Q, S, T, C, W, F, H, or A
X$_5$ is D, E, G or A
X$_6$ is V, A, L, I, P, F, M or T
X$_7$ is T, G, N, Q, S, C, W, Y, V, I, P or A
X$_8$ is N, G, Q, S, T, C, W, Y or A
X$_9$ is K, R, H, Q or A
X$_{10}$ is D, E, G or A; and/or
(c) a VH CDR3 comprising, consisting of, or consisting essentially of the amino acid sequence SGTVRGX$_1$X$_2$X$_3$ (SEQ ID NO: 3), wherein
X$_1$ is F, A, V, L, I, P, M, Y, W, H or S
X$_2$ is A, or D
X$_3$ is Y, G, N, Q, S, T, C, W, F, H or V.

In specific embodiments, the antibody or antigen-binding fragment thereof comprises one, two or all three of the VH CDRs above. In certain embodiments, the antibody or antigen-binding fragment thereof comprises the VH CDR1 of one of the antibodies in Table 2. In some embodiments, the antibody or antigen-binding fragment thereof comprises the VH CDR2 of one of the antibodies in Table 2. In certain embodiments, the antibody or antigen-binding fragment thereof comprises the VH CDR3 of one of the antibodies in Table 2. In some embodiments, the antibody or antigen-binding fragment thereof comprises one, two or all three of VH CDRs of one of the antibodies in Table 2 (e.g., the VH CDRs in one row of Table 2, for example, all of the VH CDRs are from the antibody 231-32-15). In some embodiments, the antibody or antigen-binding fragment thereof comprises the VH frameworks described herein. In specific embodiments, the antibody or antigen-binding fragment thereof comprises the VH framework regions of an antibody set forth in Table 4 (e.g., one, two, three or four of the framework regions in one row of Table 4).

TABLE 1

VL CDR Amino Acid Sequences[1]

| Antibody | VL CDR1 (SEQ ID NO:) | VL CDR2 (SEQ ID NO:) | VL CDR3 (SEQ ID NO:) |
|---|---|---|---|
| 231-32-15 | KSSQSLLNSGNQKNYLT (16) | WASTRES (17) | QNDYSYPYT (18) |
| Hum231#1 | KSSQSLLNSGNQKNYLT (16) | WASTRES (17) | QNDYSYPYT (18) |
| Hum231#2 | KSSQSLLNSGNQKNYLT (16) | WASTRES (17) | QNDYSYPYT (18) |
| pab1964 | KSSQSLLNSGNQKNYLS (101) | WASTRES (105) | QNEYSYPYT (106) |
| pab1965 | KSSQSLLNSGNQKNYLT (102) | WASTRES (105) | QNDYSYPYT (107) |
| pab1966 | KSSQSLLNSGNQKNYLT (102) | WASTRES (105) | QNDYSYPYT (107) |
| pab1967 | KSSQSLLNSSNQKNYLT (103) | WASTRES (105) | QNEYSFPYT (108) |
| pab1968 | KSSQSLLNSGNQKNYLS (101) | WASTRES (105) | QNDYSYPYT (107) |
| pab1969 | KSSQSLLNSSNQKNYLT (103) | WASTRES (105) | QNDYSFPYT (109) |
| pab1970 | KSSQSLLNSGNQKNYLS (101) | WASTRES (105) | QNDYSFPYT (109) |
| pab1971 | KSSQSLLNSSNQKNYLT (103) | WASTRES (105) | QNDYSYPYT (107) |

TABLE 1-continued

VL CDR Amino Acid Sequences[1]

| Antibody | VL CDR1 (SEQ ID NO:) | VL CDR2 (SEQ ID NO:) | VL CDR3 (SEQ ID NO:) |
|---|---|---|---|
| pab1972 | KSSQSLLNSSNQKNYLS (104) | WASTRES (105) | QNDYSYPYT (107) |
| pab1973 | KSSQSLLNSSNQKNYLT (103) | WASTRES (105) | QNDYSYPYT (107) |
| pab1975 | KSSQSLLNSGNQKNYLT (102) | WASTRES (105) | QNDYSYPYT (107) |
| pab1976 | KSSQSLLNSGNQKNYLS (101) | WASTRES (105) | QNDYSYPYT (107) |
| pab1977 | KSSQSLLNSSNQKNYLT (103) | WASTRES (105) | QNDYSYPYT (107) |
| pab1979 | KSSQSLLNSGNQKNYLT (102) | WASTRES (105) | QNDYSYPYT (107) |
| pab1980 | KSSQSLLNSGNQKNYLS (101) | WASTRES (105) | QNDYSYPYT (107) |
| pab1981 | KSSQSLLNSSNQKNYLT (103) | WASTRES (105) | QNDYSYPYT (107) |
| pab1983 | KSSQSLLNSGNQKNYLT (102) | WASTRES (105) | QNDYSYPYT (107) |
| pab2159 | KSSQSLLNSGNQKNYLT (102) | WASTRES (105) | QNDYSFPYT (109) |
| pab2160 | KSSQSLLNSGNQKNYLT (102) | WASTRES (105) | QNDYSYPYT (107) |
| pab2161 | KSSQSLLNSSNQKNYLT (103) | WASTRES (105) | QNDYSFPYT (109) |
| 1 | KSSQSLLNSGNQKNYLT (102) | WASTRES (105) | QNDYSYPYT (107) |
| 2 | KSSQSLLNSGNQKNYLS (101) | WASTRES (105) | QNEYSFPYT (108) |
| 3 | KSSQSLLNSGNQKNYLS (101) | WASTRES (105) | QNDYSFPYT (109) |
| 4 | KSSQSLLNSSNQKNYLS (104) | WASTRES (105) | QNDYSYPYT (107) |
| 5 | KSSQSLLNSSNQKNYLT (103) | WASTRES (105) | QNEYSFPYT (108) |
| 6 | KSSQSLLNSGNQKNYLS (101) | WASTRES (105) | QNDYSYPYT (107) |
| 7 | KSSQSLLNSSNQKNYLS (104) | WASTRES (105) | QNEYSFPYT (108) |
| 8 | KSSQSLLNSGNQKNYLT (102) | WASTRES (105) | QNEYSYPYT (106) |
| 9 | KSSQSLLNSGNQKNYLT (102) | WASTRES (105) | QNDYSFPYT (109) |
| 10 | KSSQSLLNSSNQKNYLS (104) | WASTRES (105) | QNDYSYPYT (107) |
| 11 | KSSQSLLNSSNQKNYLS (104) | WASTRES (105) | QNDYSFPYT (109) |
| 12 | KSSQSLLNSGNQKNYLS (101) | WASTRES (105) | QNDYSFPYT (109) |
| 13 | KSSQSLLNSSNQKNYLT (103) | WASTRES (105) | QNDYSFPYT (109) |
| 14 | KSSQSLLNSGNQKNYLS (101) | WASTRES (105) | QNDYSYPYT (107) |
| 15 | KSSQSLLNSGNQKNYLS (101) | WASTRES (105) | QNDYSYPYT (107) |
| 16 | KSSQSLLNSGNQKNYLT (102) | WASTRES (105) | QNDYSYPYT (107) |
| 17 | KSSQSLLNSGNQKNYLS (101) | WASTRES (105) | QNEYSFPYT (108) |
| 18 | KSSQSLLNSGNQKNYLT (103) | WASTRES (105) | QNDYSYPYT (107) |
| 19 | KSSQSLLNSSNQKNYLS (104) | WASTRES (105) | QNDYSFPYT (109) |
| 20 | KSSQSLLNSGNQKNYLT (102) | WASTRES (105) | QNDYSYPYT (107) |
| 21 | KSSQSLLNSGNQKNYLT (102) | WASTRES (105) | QNDYSYPYT (107) |
| 22 | KSSQSLLNSGNQKNYLS (101) | WASTRES (105) | QNDHSFPYT (191) |
| 23 | KSSQSLLNSGNQKNYLS (101) | WASTRES (105) | QNDYSSPYT (192) |
| 24 | KSSQSLLNSSNQKNYLT (103) | WASTRES (105) | QNDYSFPYT (109) |
| 25 | KSSQSLLNSGNQKNYLT (102) | WASTRES (105) | QNDYSFPYT (109) |

TABLE 1-continued

VL CDR Amino Acid Sequences[1]

| Antibody | VL CDR1 (SEQ ID NO:) | VL CDR2 (SEQ ID NO:) | VL CDR3 (SEQ ID NO:) |
|---|---|---|---|
| 26 | KSSQSLLNSGNQKNYLT (102) | WASTRES (105) | QNEYSFPYT (108) |
| 27 | KSSQSLLNSSNQKNYLS (104) | WASTRES (105) | QNDYSFPYT (109) |
| 28 | KSSQSLLNSGNQKNYLS (101) | WASTRES (105) | QNDYSFPYT (109) |
| 29 | KSSQSLLNSSNQKNYLS (104) | WASTRES (105) | QNDYSYPYT (107) |
| 30 | KSSQSLLNSGNQKNYLS (101) | WASTRES (105) | QNDYSYPYT (107) |
| 31 | KSSQSLLNSSNQKNYLT (103) | WASTRES (105) | QNDYSYPYT (107) |
| 32 | KSSQSLLNSGNQKNYLT (102) | WASTRES (105) | QNDYSYPYT (107) |
| 33 | KSSQSLLNSGNQKNYLS (101) | WASTRES (105) | QNEYSYPYT (106) |
| 34 | KSSQSLLNSSNQKNYLT (103) | WASTRES (105) | QNDYSYPYT (107) |
| 35 | KSSQSLLNSGNQKNYLT (102) | WASTRES (105) | QNDYSYPYT (107) |
| 36 | KSSQSLLNSSNQKNYLT (103) | WASTRES (105) | QNDYSFPYT (109) |
| 37 | KSSQSLLNSGNQKNYLT (102) | WASTRES (105) | QNEYSYPYT (106) |
| 38 | KSSQSLLNSGNQKNYLT (102) | WASTRES (105) | QNDYSYPYT (107) |
| 39 | KSSQSLLNSSNQKNYLT (103) | WASTRES (105) | QNEYSFPYT (108) |
| 40 | KSSQSLLNSGNQKNYLS (101) | WASTRES (105) | QNEYSYPYT (106) |
| 41 | KSSQSLLNSGNQKNYLT (102) | WASTRES (105) | QNDYSYPYT (107) |
| 42 | KSSQSLLNSGNQKNYLS (101) | WASTRES (105) | QNDYSYPYT (107) |
| 43 | KSSQSLLNSGNQKNYLT (102) | WASTRES (105) | QNDYSYPYT (107) |
| 44 | KSSQSLLNSGNQKNYLT (102) | WASTRES (105) | QNEYSFPYT (108) |
| 45 | KSSQSLLNSGNQKNYLS (101) | WASTRES (105) | QNDYSFPYT (109) |
| 46 | KSSQSLLNSGNQKNYLS (101) | WASTRES (105) | QNDYSYPYT (107) |
| 47 | KSSQSLLNSGNQKNYLS (101) | WASTRES (105) | QNDYSFPYT (109) |
| 48 | KSSQSLLNSGNQKNYLS (101) | WASTRES (105) | QNEYSFPYT (108) |
| 49 | KSSQSLLNSGNQKNYLT (102) | WASTRES (105) | QNDYSFPYT (109) |
| 50 | KSSQSLLNSSNQKNYLT (103) | WASTRES (105) | QNDYSYPYT (107) |
| 51 | KSSQSLLNSGNQKNYLT (102) | WASTRES (105) | QNDYSSPYT (192) |
| 52 | KSSQSLLNSGNQKNYLT (102) | WASTRES (105) | QNDYSFPYT (109) |
| 53 | KSSQSLLNSGNQKNYLS (101) | WASTRES (105) | QNDYSYPYT (107) |
| 54 | KSSQSLLNSSNQKNYLT (103) | WASTRES (105) | QNDYSFPYT (109) |
| 55 | KSSQSLLNSGNQKNYLS (101) | WASTRES (105) | QNDYSFPYT (109) |
| 56 | KSSQSLLNSSNQKNYLS (104) | WASTRES (105) | QNDYSYPYT (107) |
| 57 | KSSQSLLNSSNQKNYLS (104) | WASTRES (105) | QNDYSYPYT (107) |
| 58 | KSSQSLLNSGNQKNYLS (101) | WASTRES (105) | QNDYSYPYT (107) |
| 59 | KSSQSLLNSSNQKNYLS (104) | WASTRES (105) | QNDYSYPYT (107) |
| 60 | KSSQSLLNSGNQKNYLT (102) | WASTRES (105) | QNEYSYPYT (106) |
| 61 | KSSQSLLNSGNQKNYLS (101) | WASTRES (105) | QNDYSFPYT (109) |
| 62 | KSSQSLLNSGNQKNYLT (102) | WASTRES (105) | QNEYSFPYT (108) |
| 63 | KSSQSLLNSGNQKNYLS (101) | WASTRES (105) | QNDYSFPYT (109) |

TABLE 1-continued

VL CDR Amino Acid Sequences[1]

| Antibody | VL CDR1 (SEQ ID NO:) | VL CDR2 (SEQ ID NO:) | VL CDR3 (SEQ ID NO:) |
|---|---|---|---|
| 64 | KSSQSLLNSSNQKNYLS (104) | WASTRES (105) | QNEYSYPYT (106) |
| 65 | KSSQSLLNSSNQKNYLS (104) | WASTRES (105) | QNEYSFPYT (108) |
| 66 | KSSQSLLNSSNQKNYLS (104) | WASTRES (105) | QNDYSFPYT (109) |
| 67 | KSSQSLLNSGNQKNYLT (102) | WASTRES (105) | QNDYSFPYT (109) |
| 68 | KSSQSLLNSGNQKNYLT (102) | WASTRES (105) | QNDYSYPYT (107) |
| 69 | KSSQSLLNSSNQKNYLT (103) | WASTRES (105) | QNDYSFPYT (109) |
| 70 | KSSQSLLNSGNQKNYLS (101) | WASTRES (105) | QNDYSFPYT (109) |
| 71 | KSSQSLLNSSNQKNYLT (103) | WASTRES (105) | QNDYSYPYT (107) |
| 72 | KSSQSLLNSGNQKNYLT (102) | WASTRES (105) | QNEYSFPYT (108) |
| 73 | KSSQSLLNSGNQKNYLT (102) | WASTRES (105) | QNDYSFPYT (109) |
| 74 | KSSQSLLNSGNQKNYLS (101) | WASTRES (105) | QNDYSYPYT (107) |
| 75 | KSSQSLLNSGNQKNYLS (101) | WASTRES (105) | QNDYSYPYT (107) |
| 76 | KSSQSLLNSGNQKNYLS (101) | WASTRES (105) | QNDYSFPYT (109) |
| 77 | KSSQSLLNSSNQKNYLT (103) | WASTRES (105) | QNDYSFPYT (109) |
| 78 | KSSQSLLNSGNQKNYLT (102) | WASTRES (105) | QNDYSYPYT (107) |
| 79 | KSSQSLLNSGNQKNYLT (102) | WASTRES (105) | QNDYSYPYT (107) |
| 80 | KSSQSLLNSSNQKNYLT (103) | WASTRES (105) | QNDYSFPYT (109) |
| 81 | KSSQSLLNSSNQKNYLS (104) | WASTRES (105) | QNDYSYPYT (107) |
| 82 | KSSQSLLNSSNQKNYLS (104) | WASTRES (105) | QNDYSYPYT (107) |
| 83 | KSSQSLLNSSNQKNYLT (103) | WASTRES (105) | QNDYSFPYT (109) |
| 84 | KSSQSLLNSSNQKNYLT (103) | WASTRES (105) | QNDYSFPYT (109) |
| 85 | KSSQSLLNSSNQKNYLS (104) | WASTRES (105) | QNDYSYPYT (107) |
| 86 | KSSQSLLNSGNQKNYLT (102) | WASTRES (105) | QNDYSYPYT (107) |
| 87 | KSSQSLLNSGNQKNYLT (102) | WASTRES (105) | QNDYSYPYT (107) |
| 88 | KSSQSLLNSGNQKNYLT (102) | WASTRES (105) | QNDYSFPYT (109) |
| 89 | KSSQSLLNSGNQKNYLT (102) | WASTRES (105) | QNDYSFPYT (109) |
| 90 | KSSQSLLNSGNQKNYLS (101) | WASTRES (105) | QNEYSSPYT (193) |
| 91 | KSSQSLLNSGNQKNYLS (101) | WASTRES (105) | QNEYSFPYT (108) |
| 92 | KSSQSLLNSGNQKNYLT (102) | WASTRES (105) | QNDYSYPYT (107) |
| 93 | KSSQSLLNSSNQKNYLT (103) | WASTRES (105) | QNDYSYPYT (107) |
| 94 | KSSQSLLNSGNQKNYLT (102) | WASTRES (105) | QNDYSYPYT (107) |
| 95 | KSSQSLLNSGNQKNYLT (102) | WASTRES (105) | QNDYSFPYT (109) |
| 96 | KSSQSLLNSSNQKNYLS (104) | WASTRES (105) | QNDYSYPYT (107) |
| 97 | KSSQSLLNSGNQKNYLT (102) | WASTRES (105) | QNEYSFPYT (108) |
| 98 | KSSQSLLNSGNQKNYLS (101) | WASTRES (105) | QNDYSYPYT (107) |
| 99 | KSSQSLLNSGNQKNYLT (102) | WASTRES (105) | QNDYSFPYT (109) |
| 100 | KSSQSLLNSGNQKNYLS (101) | WASTRES (105) | QNDYSSPYT (192) |

TABLE 1-continued

VL CDR Amino Acid Sequences[1]

| Antibody | VL CDR1 (SEQ ID NO:) | VL CDR2 (SEQ ID NO:) | VL CDR3 (SEQ ID NO:) |
|---|---|---|---|
| 101 | KSSQSLLNSSNQKNYLT (103) | WASTRES (105) | QNDYSFPYT (109) |
| 102 | KSSQSLLNSSNQKNYLS (104) | WASTRES (105) | QNDYSYPYT (107) |
| 103 | KSSQSLLNSSNQKNYLS (104) | WASTRES (105) | QNDYSSPYT (192) |
| 104 | KSSQSLLNSGNQKNYLS (101) | WASTRES (105) | QNEYSYPYT (106) |
| 105 | KSSQSLLNSGNQKNYLS (101) | WASTRES (105) | QNDYSYPYT (107) |
| 106 | KSSQSLLNSSNQKNYLT (103) | WASTRES (105) | QNDYSYPYT (107) |
| 107 | KSSQSLLNSGNQKNYLS (101) | WASTRES (105) | QNDYSYPYT (107) |

[1]The VL CDRs in Table 1 are determined according to Kabat.

TABLE 2

VH CDR Amino Acid Sequences[2]

| Antibody | VH CDR1 (SEQ ID NO:) | VH CDR2 (SEQ ID NO:) | VH CDR3 (SEQ ID NO:) |
|---|---|---|---|
| 231-32-15 | DYAMY (13) | VIRTYSGDVTYNQKFKD (14) | SGTVRGFAY (15) |
| Hum231#1 | DYAMY (13) | VIRTYSGDVTYNQKFKD (14) | SGTVRGFAY (15) |
| Hum231#2 | DYAMY (13) | VIRTYSGDVTYNQKFKD (14) | SGTVRGFAY (15) |
| pab1964 | GYAMY (19) | LIRTYSGGVTYNQKFQG (24) | SGTVRGFAY (34) |
| pab1965 | GYAMY (19) | VIRTFSGDVTYNQKFRG (25) | SGTVRGFAY (34) |
| pab1966 | GYAMY (19) | VIKTYSGGVTYNQKFRG (26) | SGTVRGFAY (34) |
| pab1967 | GYAMH (20) | LIRTYSGGVSYNQKFRE (27) | SGTVRGFAY (34) |
| pab1968 | DYAMY (21) | VIRTFSGDLTYNQKFQD (28) | SGTVRGFAY (34) |
| pab1969 | EYAMH (22) | LIRTYSGGVSYNQKFQG (29) | SGTVRGFAY (34) |
| pab1970 | DYAMY (21) | LIRTYSGGVTYNQKFQG (24) | SGTVRGFAY (34) |
| pab1971 | DYAMY (21) | VIRTYSGDVSYNQKFRG (177) | SGTVRGFAY (34) |
| pab1972 | EYAMY (23) | LIRTYSGGVSYNQKFRD (31) | SGTVRGFAY (34) |
| pab1973 | GYAMY (19) | VIRTFSGGVTYNQKFRG (32) | SGTVRGFAY (34) |
| pab1975 | EYAMH (22) | LIRTYSGGVSYNQKFQG (29) | SGTVRGFAY (34) |
| pab1976 | EYAMH (22) | LIRTYSGGVSYNQKFQG (29) | SGTVRGFAY (34) |
| pab1977 | EYAMH (22) | LIRTYSGGVSYNQKFQG (29) | SGTVRGFAY (34) |
| pab1979 | EYAMH (22) | VIRTYSGGVSYNQKFQE (33) | SGTVRGFAY (34) |
| pab1980 | EYAMH (22) | VIRTYSGGVSYNQKFQE (33) | SGTVRGFAY (34) |
| pab1981 | EYAMH (22) | VIRTYSGGVSYNQKFQE (33) | SGTVRGFAY (34) |
| pab1983 | GYAMY (19) | LIRTYSGGVTYNQKFQG (24) | SGTVRGFAY (34) |
| pab2159 | GYAMY (19) | LIRTYSGEVSYNQKFRG (144) | SGTVRGFAY (34) |
| pab2160 | GYVMH (119) | VIRTFSGDVSYNQKFRE (162) | SGTVRGFAY (34) |
| pab2161 | EYAMH (22) | LIQTYSGDVSYNQKFRG (121) | SGTVRGFAY (34) |
| 1 | EYAMY (23) | VIRTYSGGVTYNQKFQG (187) | SGTVRGFAY (34) |
| 2 | EYAMH (22) | LIRTYSGGVSYNQKFRG (148) | SGTVRGFAY (34) |

TABLE 2-continued

VH CDR Amino Acid Sequences[2]

| Antibody | VH CDR1 (SEQ ID NO:) | VH CDR2 (SEQ ID NO:) | VH CDR3 (SEQ ID NO:) |
|---|---|---|---|
| 3 | GYVMH (119) | VIRTYSGEVSYNQKFQE (181) | SGTVRGFAY (34) |
| 4 | EYAMY (23) | LIRTFSGDVSYNQKFQD (124) | SGTVRGFAY (34) |
| 5 | EYAMH (22) | LIRTYSGGVTYNQKFRG (151) | SGTVRGFAY (34) |
| 6 | EYAMY (23) | LIRTFSGGVSYNQKFKG (135) | SGTVRGFAY (34) |
| 7 | GYAMH (20) | LIRTFSGGLSYNQKFRE (132) | SGTVRGFAY (34) |
| 8 | GYVMY (116) | VIKTFSGGVSYNQKFQE (152) | SGTVRGFAY (34) |
| 9 | GYAMY (19) | LIRTYSGEVSYNQKFRG (144) | SGTVRGFAY (34) |
| 10 | EYAMY (23) | LIRTYSGGVSYNQKFRG (148) | SGTVRGFAY (34) |
| 11 | DYAMH (117) | LIRTYSGGVSYNQKFRG (148) | SGTVRGFAY (34) |
| 12 | GYAMY (19) | VIRTFSGEVSYNQKFKG (164) | SGTVRGFAY (34) |
| 13 | GYAMY (19) | LIRTFSGDVTYNQKFRG (127) | SGTVRGFAY (34) |
| 14 | GYVMH (119) | LIRTYSGDVSYNQKFRD (146) | SGTVRGFAY (34) |
| 15 | DYAMY (21) | VIRTFSGDVSYNQKFRE (162) | SGTVRGFAY (34) |
| 16 | GYAMY (19) | LIRTFSGGVTYNQKFRE (140) | SGTVRGFAY (34) |
| 17 | EYAMY (23) | VIQTFSGGVTYNQKFRG (157) | SGTVRGFAY (34) |
| 18 | GYAMY (19) | LIRTFSGEVTYNQKFRG (130) | SGTVRGFAY (34) |
| 19 | GYAMY (19) | LIRTYSGGLSYNQKFQD (145) | SGTVRGFAY (34) |
| 20 | DYAMY (21) | VIRTFSDLSYNQKFRG (114) | SGTVRGFAY (34) |
| 21 | GYVMH (119) | VIRTFSGDVSYNQKFRE (162) | SGTVRGFAY (34) |
| 22 | GYAMY (19) | VIRTFSGDVTYNQKFRG (25) | SGTVRGFAY (34) |
| 23 | GYAMY (19) | LIRTFSGDVTYNQKFRG (127) | SGTVRGFAY (34) |
| 24 | DYAMH (117) | LIRTYSGGVTYNQKFRG (151) | SGTVRGFAY (34) |
| 25 | EYAMY (23) | LIRTFSGGVSYNQKFRG (138) | SGTVRGFAY (34) |
| 26 | EYAMH (22) | LIRTFSGDVSYNQKFKG (123) | SGTVRGFAY (34) |
| 27 | DYAMY (21) | LIRTYSGGVSYNQKFRG (148) | SGTVRGFAY (34) |
| 28 | DYAMY (21) | VIRTFSGGVTYNQKFRG (32) | SGTVRGFAY (34) |
| 29 | DYAMY (21) | VIRTFSGGVTYNQKFKG (172) | SGTVRGFAY (34) |
| 30 | DYVMY (35) | VIRTFSGGLSYNQKFRG (165) | SGTVRGFAY (34) |
| 31 | EYAMY (23) | LIRTFSGGLTYNQKFKD (133) | SGTVRGFAY (34) |
| 32 | DYAMY (21) | VIRTFSGGVTYNQKFKD (171) | SGTVRGFAY (34) |
| 33 | GYAMY (19) | LIRTYSGGVTYNQKFQG (24) | SGTVRGFAY (34) |
| 34 | DYAMY (21) | VIRTFSGGVTYNQKFRG (32) | SGTVRGFAY (34) |
| 35 | GYAMY (19) | VIRTFSGDVTYNQKFRG (25) | SGTVRGFAY (34) |
| 36 | DYAMY (21) | VIRTFSGGVSYNQKFRD (168) | SGTVRGFAY (34) |
| 37 | EYAMY (23) | LIRTFSGEVTYNQKFKD (129) | SGTVRGFAY (34) |
| 38 | GYAMY (19) | VIKTYSGGVTYNQKFRG (26) | SGTVRGFAY (34) |
| 39 | GYAMH (20) | LIRTYSGGVSYNQKFRE (27) | SGTVRGFAY (34) |
| 40 | EYAMY (23) | VIRTYSGDLSYNQKFRG (174) | SGTVRGFAY (34) |

TABLE 2-continued

VH CDR Amino Acid Sequences[2]

| Antibody | VH CDR1 (SEQ ID NO:) | VH CDR2 (SEQ ID NO:) | VH CDR3 (SEQ ID NO:) |
|---|---|---|---|
| 41 | DYVMY (35) | VIRTFSGGVSYNQKFRG (170) | SGTVRGFAY (34) |
| 42 | DYAMY (21) | VIRTFSGDLTYNQKFQD (28) | SGTVRGFAY (34) |
| 43 | EYAMY (23) | LIRTFSGDVSYNQKFKG (123) | SGTVRGFAY (34) |
| 44 | EYAMH (22) | LIRTYSGDVSYNQKFQG (142) | SGTVRGFAY (34) |
| 45 | EYAMY (23) | LIRTYSGGVSYNQKFQG (147) | SGTVRGFAY (34) |
| 46 | EYAMY (23) | LIRTFSGDLSYNQKFRG (122) | SGTVRGFAY (34) |
| 47 | DYAMY (21) | VIRTYSGGVTYNQKFRD (188) | SGTVRGFAD (189) |
| 48 | DYAMY (21) | LIRTYSGGVTYNQKFKE (149) | SGTVRGFAY (34) |
| 49 | GYAMY (19) | VIRTYSGDVTYNQKFRE (179) | SGTVRGFAY (34) |
| 50 | DYAMY (21) | LIRTFSGGVSYNQKFKE (134) | SGTVRGFAY (34) |
| 51 | EYAMY (23) | VIRTFSGGVTYNQKFKG (172) | SGTVRGFAY (34) |
| 52 | DYAMY (21) | LIRTYSGGVSYNQKFRE (27) | SGTVRGFAY (34) |
| 53 | EYAMH (22) | VIRTYSGGLSYNQKFRG (182) | SGTVRGFAY (34) |
| 54 | EYAMH (22) | LIRTYSGGVSYNQKFQG (147) | SGTVRGFAY (34) |
| 55 | DYAMY (21) | LIRTYSGGVTYNQKFQG (24) | SGTVRGFAY (34) |
| 56 | DYAMY (21) | VIRTYSGDVSYNQKFRG (177) | SGTVRGFAY (34) |
| 57 | GYAMY (19) | LIRTYSGDVTYNQKFKD (143) | SGTVRGFAY (34) |
| 58 | DYAMY (21) | VIRTYSGGVTYNQKFKG (186) | SGTVRGFAY (34) |
| 59 | EYAMY (23) | LIRTYSGGVSYNQKFRD (31) | SGTVRGFAY (34) |
| 60 | DYAMY (21) | VIKTYSGGVSYNQKFRG (153) | SGTVRGFAY (34) |
| 61 | EYAMH (22) | LIRTYSGGVSYNQKFQE (115) | SGTVRGFAY (34) |
| 62 | GYVMY (116) | VIRTFSGGVSYNQKFQG (167) | SGTVRGFAY (34) |
| 63 | EYAMY (23) | VIRTFSGDVTYNQKFKG (163) | SGTVRGFAY (34) |
| 64 | DYAMY (21) | VIRTYSGDVTYNQKFRG (180) | SGTVRGFAY (34) |
| 65 | EYAMY (23) | VIKTYSGGVTYNQKFRG (26) | SGTVRGFAY (34) |
| 66 | DYVMY (35) | VIRTYSGEVSYNQKFRG (183) | SGTVRGFAY (34) |
| 67 | EYAMY (23) | VIQTFSGDVSYNQKFKG (156) | SGTVRGFAY (34) |
| 68 | GYAMY (19) | LIRTYSGGVTYNQKFRG (151) | SGTVRGFAY (34) |
| 69 | EYVMH (118) | VIRTFSGGVSYNQKFRE (169) | SGTVRGFAY (34) |
| 70 | GYAMY (19) | VIRTYSGDVTYNQKFKD (178) | SGTVRGFAY (34) |
| 71 | GYAMY (19) | VIRTFSGGVTYNQKFRG (32) | SGTVRGFAY (34) |
| 72 | GYAMY (19) | VIRTYSGDVSYNQKFQE (175) | SGTVRGFAY (34) |
| 73 | GYVMH (119) | IIKTYSGGVSYNQKFQG (120) | SGTVRGFAY (34) |
| 74 | DYAMY (21) | VIKTYSGGVTYNQKFKD (154) | SGTVRGFAY (34) |
| 75 | GYAMY (19) | VIRTYSGGVTYNQKFQG (187) | SGTVRGFAY (34) |
| 76 | DYAMH (117) | LIRTFSGDVSYNQKFRE (125) | SGTVRGFAY (34) |
| 77 | EYAMH (22) | LIQTYSGDVSYNQKFRG (121) | SGTVRGFAY (34) |

TABLE 2-continued

VH CDR Amino Acid Sequences[2]

| Antibody | VH CDR1 (SEQ ID NO:) | VH CDR2 (SEQ ID NO:) | VH CDR3 (SEQ ID NO:) |
|---|---|---|---|
| 78 | DYAMY (21) | VIKTYSGGVTYNQKFRD (155) | SGTVRGFAY (34) |
| 79 | EYAMH (22) | LIRTYSGGVTYNQKFRE (150) | SGTVRGFAY (34) |
| 80 | EYAMH (22) | LIRTFSGDVSYNQKFRG (126) | SGTVRGFAY (34) |
| 81 | DYAMY (21) | LIRTFSGEVSYNQKFQD (128) | SGTVRGFAY (34) |
| 82 | GYVMH (119) | VIRTFSGGVSYNQKFRG (170) | SGTVRGFAY (34) |
| 83 | GYAMY (19) | VIRTFSGDVSYNQKFRD (161) | SGTVRGFAY (34) |
| 84 | GYAMY (19) | LIRTFSGDVTYNQKFRG (127) | SGTVRGFAY (34) |
| 85 | EYAMY (23) | VIRTYSGGVTYNQKFKD (185) | SGTVRGFAY (34) |
| 86 | EYAMY (23) | VIRTYSGGVTYNQKFRD (188) | SGTVRGFAY (34) |
| 87 | GYAMY (19) | VIRTFSGDLSYNQKFKG (159) | SGTVRGFAY (34) |
| 88 | EYAMH (22) | VIRTYSGDVSYNQKFRG (177) | SGTVRGFAY (34) |
| 89 | GYAMY (19) | VIRTFSGDVTYNQKFRG (25) | SGTVRGFAY (34) |
| 90 | EYAMY (23) | LIRTYSGDLSYNQKFKE (141) | SGTVRGFAY (34) |
| 91 | EYAMH (22) | LIRTYSGGVSYNQKFQE (115) | SGTVRGFAY (34) |
| 92 | EYAMY (23) | LIRTFSGGVTYNQKFQG (139) | SGTVRGFAY (34) |
| 93 | DYAMH (117) | VIQTYSGDVSYNQKFQG (158) | SGTVRGFAY (34) |
| 94 | GYAMY (19) | VIRTFSGGVTYNQKFRD (173) | SGTVRGFAY (34) |
| 95 | DYAMY (21) | LIRTYSGGVSYNQKFRG (148) | SGTVRGFAY (34) |
| 96 | EYAMY (23) | VIRTYSGGLTYNQKFRD (184) | SGTVRGFAY (34) |
| 97 | EYAMH (22) | LIRTFSGGLSYNQKFRD (131) | SGTVRGFAY (34) |
| 98 | GYAMH (20) | VIRTFSGGVSYNQKFQE (166) | SGTVRGFAY (34) |
| 99 | DYAMH (117) | LIRTFSGDLSYNQKFRG (122) | SGTVRGFAY (34) |
| 100 | EYAMH (22) | VIRTFSGGVSYNQKFQG (167) | SGTVRGFAY (34) |
| 101 | DYAMH (117) | LIRTFSGGVSYNQKFQD (136) | SGTVRGFAY (34) |
| 102 | GYAMY (19) | VIRTYSGGVSYNQKFRD (194) | SGTVRGFAY (34) |
| 103 | GYAMY (19) | VIRTYSGDVSYNQKFRG (177) | SGTVRGFAY (34) |
| 104 | DYAMY (21) | LIRTFSGGVSYNQKFRD (137) | SGTVRGFAY (34) |
| 105 | EYAMY (23) | LIRTFSGGVSYNQKFKG (135) | SGTVRGFAY (34) |
| 106 | DYAMY (21) | VIRTFSGDVSYNQKFQE (160) | SGTVRGFAY (34) |
| 107 | GYAMY (19) | VIRTYSGDVSYNQKFRD (176) | SGTVRGFAY (34) |

[2]The VH CDRs in Table 2 are determined according to Kabat.

TABLE 3

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 231-32-15 | DIVMTQSPSSLTVTAGEKVIMSC (616) | WYQQKPGQPPKLLIY (623) | GVPDRFTGSGSGTDFTLTISSVQAEDLAVYHC (637) | FGGGTKLEIK (641) |

TABLE 3-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| Hum231 #1 | DIVMTQSPPTLSLSPGERVTLSC (615) | WYQQKPGQAPRLLIY (622) | GIPARFSGSGSGTDFTLTISSLQPEDFAVYHC (626) | FGQGTKLEIK (643) |
| Hum231 #2 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |
| pab1964 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| pab1965 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| pab1966 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| pab1967 | DIVMTQSPDSLAVSLGERATINC (611) | WYQQKPGQPPKLLIY (623) | GVPDRFTGSGSGTDFTLTISSVQAEDVAVYYC (638) | FGQGTKLEIK (643) |
| pab1968 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| pab1969 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| pab1970 | DIVMTQSPDSLAVSLGERATINC (611) | WYQQKPGQPPKLLIY (623) | GVPDRFSGSGSGTDFTLTISSVQAEDVAVYHC (632) | FGQGTKLEIK (643) |
| pab1971 | DIVMTQSPDSLAVSLGERATINC (611) | WYQQKPGQPPKLLIY (623) | GVPDRFTGSGSGTDFTLTISSLQAEDVAVYYC (642) | FGQGTKLEIK (643) |
| pab1972 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| pab1973 | DIVMTQSPDSLAVSLGERATINC (611) | WYQQKPGQPPKLLIY (623) | GVPDRFTGSGSDTDFTLTISSVQAEDVAVYHC (627) | FGQGTKLEIK (643) |
| pab1975 | DIVMTQSPDSLAVSLGERATINC (611) | WYQQKPGQPPKLLIY (623) | GVPDRFTGSGSGTDFTLTISSLQAEDVAVYYC (631) | FGQGTKLEIK (643) |
| pab1976 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| pab1977 | DIVMTQSPDSLAVSLGERATINC (611) | WYQQKPGQPPKLLIY (623) | GVPDRFTGSGSGTDFTLTISSLQAEDVAVYYC (642) | FGQGTKLEIK (643) |
| pab1979 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| pab1980 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| pab1981 | DIVMTQSPDSLAVSLGERATINC (611) | WYQQKPGQPPKLLIY (623) | GVPDRFTGSGSGTDFTLTISSLQAEDVAVYYC (642) | FGQGTKLEIK (643) |
| pab1983 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| pab2159 | DIVMTQSPDSLAVSLGERATINC (611) | WYQQKPGQPPKMLIY (624) | GVPDRFSGSGSGTDFTLTISSLQAEDVAVYHC (630) | FGQGTKLEIK (643) |
| pab2160 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| pab2161 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 1 | DIVMTQSPDSLAVSLGERATINC (611) | WYHQKPGQPPKMLIY (619) | GVPDRFSGSGSGTDFTLTISSVQAEDVAVYHC (632) | FGQGTKLEIK (643) |
| 2 | DIVMTQSPDSLAVSLGERATINC (611) | WYHQKPGQPPKLLIY (618) | GVPDRFSGSGSGTDFTLTISSVQAEDVAVYYC (633) | FGQGTKLEIK (643) |
| 3 | DIVMTQSPDSLAVSLGERATINC (611) | WYHQKPGQPPKLLIY (618) | GVPDRFTGSGSGTDFTLTISSVQAEDVAVYHC (638) | FGQGTKLEIK (643) |

TABLE 3-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 4 | DIVMTQSPDSLAVSL | WYHQKPGQP | GVPDRFTGSGSGTDFTLTI | FGQGTKLEIK |
| 5 | GERATINC (611)<br>DIVMTQSPDSLAAPG<br>ERATINC (610) | PKLLIY (618)<br>WYHQKPGQP<br>PKLLIY (618) | SSVQAEDVAVYYC (639)<br>GVPDRFTGSGSGTDFTLTI<br>SSVQAEDVAVYYC (639) | (643)<br>FGQGTKLEIK<br>(643) |
| 6 | DIVMTQSPDSLAVSL<br>GERATINC (611) | WYQQKPGQP<br>PKMLIY (624) | GVPDRFTGSGSGTDFTLTI<br>SSLQAEDVAVYHC (636) | FGQGTKLEIK<br>(643) |
| 7 | DIVMTQSPDSLAVSL<br>GERATINC (611) | WYHQKPGQP<br>PKMLIY (619) | GVPDRFSGSGSGTDFTLTI<br>SSLQAEDVAVYHC (630) | FGQGTKLEIK<br>(643) |
| 8 | DIVMTQSPDSLAVSL<br>GERATINC (611) | WYHQKPGQP<br>PKLLIY (618) | GVPDRFSGSGSGTDFTLTI<br>SSVQAEDVAVYHC (632) | FGQGTKLEIK<br>(643) |
| 9 | DIVMTQSPDSLAVSL<br>GERATINC (611) | WYQQKPGQP<br>PKMLIY (624) | GVPDRFSGSGSGTDFTLTI<br>SSLQAEDVAVYHC (630) | FGQGTKLEIK<br>(643) |
| 10 | DIVMTQSPDSLAVSL<br>GERATINC (611) | WYQQKPGQP<br>PKLLIY (623) | GVPDRFSGSGSGTDFTLTI<br>SSVQAEDVAVYHC (632) | FGQGTKLEIK<br>(643) |
| 11 | DIVMTQSPDSLAVSL<br>GERATINC (611) | WYQQKPGQP<br>PKLLIY (623) | GVPDRFSGSGSGTDFTLTI<br>SSVQAEDVAVYHC (632) | FGQGTKLEIK<br>(643) |
| 12 | DIVMTQSPDSLAVSL<br>GERATINC (611) | WYQQKPGQP<br>PKMLIY (619) | GVPDRFSGSGSGTDFTLTI<br>SSLQAEDVAVYHC (630) | FGQGTKLEIK<br>(643) |
| 13 | DIVMTQSPDSLAVSL<br>GERATINC (611) | WYQQKPGQP<br>PKLLIY (623) | GVPDRFSGSGSGTDFTLTI<br>SSVQAEDVAVYHC (632) | FGQGTKLEIK<br>(643) |
| 14 | DIVMTQSPDSLAVSL<br>GERATINC (611) | WYHQKPGQP<br>PKMLIY (619) | GVPDRFSGSGSGTDFTLTI<br>SSVQAEDVAVYYC (633) | FGQGTKLEIK<br>(643) |
| 15 | DIVMTQSPDSLAVSL<br>GERATINC (611) | WYQQKPGQP<br>PKLLIY (623) | GVPDRFTGSGSGTDFTLTI<br>SSLQAEDVAVYHC (636) | FGQGTKLEIK<br>(643) |
| 16 | DIVMTQSPDSLAVSL<br>GERATINC (611) | WYHQKPGQP<br>PKLLIY (618) | GVPDRFTGSGSGTDFTLTI<br>SSVQAEDVAVYHC (638) | FGQGTKLEIK<br>(643) |
| 17 | DIVMTQSPDSLAVSL<br>GERATINC (611) | WYHQKPGQP<br>PKMLIY (619) | GVPDRFSGSGSGTDFTLTI<br>SSVQAEDVAVYHC (632) | FGQGTKLEIK<br>(643) |
| 18 | DIVMTQSPDSLAVSL<br>GERATINC (611) | WYHQKPGQP<br>PKMLIY (619) | GVPDRFTGSGSGTDFTLTI<br>SSVQAEDVAVYYC (639) | FGQGTKLEIK<br>(643) |
| 19 | DIVMTQSPDSLAVSL<br>GERATINC (611) | WYQQKPGQP<br>PKLLIY (623) | GVPDRFTGSGSGTDFTLTI<br>SSVQAEDVAVYHC (638) | FGQGTKLEIK<br>(643) |
| 20 | DIVMTQSPDSLAVSL<br>GERATINC (611) | WYQQKPGQP<br>PKMLLY (624) | GVPDRFTGSGSGTDFTLTI<br>SSVQAEDVAVYHC (620) | FGQGTKLEIK<br>(643) |
| 21 | DIVMTQSPDSLAVSL<br>GERATINC (611) | WYHQKPGQP<br>PKLLIY (618) | GVPDRFSGSGSGTDFTLTI<br>SSVQAEDVAVYHC (632) | FGQGTKLEIK<br>(643) |
| 22 | DIVMTQSPDSLAVSL<br>GERATINC (611) | WYHQKPGQP<br>PKMLIY (619) | GVPDRFSGSGSGTDFTLTI<br>SSVQAEDVAVYHC (632) | FGQGTKLEIK<br>(643) |
| 23 | DIVMTQSPDSLAVSL<br>GERATINC (611) | WYQQKPGQP<br>PKMLIY (624) | GVPDRFSGSGSGTDFTLTI<br>SSVQAEDVAVYHC (632) | FGQGTKLEIK<br>(643) |
| 24 | DIVMTQSPDSLAVSL<br>GERATINC (611) | WYQQKPGQP<br>PKMLIY (624) | GVPDRFSGSGSGTDFTLTI<br>SSVQAEDVAVYHC (632) | FGQGTKLEIK<br>(643) |
| 25 | DIVMTQSPDSLAVSL<br>GERATINC (611) | WYQQKPGQP<br>PKMLIY (624) | GVPDRFTGSGSGTDFTLTI<br>SSVQAEDVAVYYC (639) | FGQGTKLEIK<br>(643) |
| 26 | DIVMTQSPDSLAVSL<br>GERATINC (611) | WYQQKPGQP<br>PKMLIY (624) | GVPDRFSGSGSGTDFTLTI<br>SSVQAEDVAVYYC (633) | FGQGTKLEIK<br>(643) |
| 27 | DIVMTQSPDSLAVSL<br>GERATINC (611) | WYHQKPGQP<br>PKLLIY (618) | GVPDRFSGSGSGTDFTLTI<br>SSLQAEDVAVYHC (630) | FGQGTKLEIK<br>(643) |
| 28 | DIVMTQSPDSLAVSL<br>GERATINC (611) | WYHQKPGQP<br>PKLLIY (618) | GVPDRFSGSGSGTDFTLTI<br>SSLQAEDVAVYHC (630) | FGQGTKLEIK<br>(643) |

TABLE 3-continued

VL FR Amino Acid Sequences³

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 29 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |
| 30 | DIVMTQSPDSLAVSLGERATINC (611) | WYHQKPGQPPKLLIY (618) | GVPDRFSGSGSGTDFTLTISSLQAEDVAVYYC (631) | FGQGTKLEIK (643) |
| 31 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 32 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 33 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 34 | DIVMTQSTDSLAVSLGERATINC (617) | WYQQKPGQPPKLLIY (623) | GVPDRFTGSGSGTDFTLTISSLQAEDVAVYHC (636) | FGQGTKLEIK (643) |
| 35 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 36 | DIVMTQSPDSLAVSLGERATINC (611) | WYHQKPGQPPKMLIY (619) | GVPDRFSGSGSGTDFTLTISSVQEEDVAVYHC (634) | FGQGTKLEIK (643) |
| 37 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 38 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| 39 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 40 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 41 | DIVMTQSPDSLAVSLGERATINC (611) | WYHQKPGQPPKLLIY (618) | GVPDRFSGSGSGTDFTLTISSLQAEDVAVYHC (630) | FGQGTKLEIK (643) |
| 42 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| 43 | DIVMTQSPDSLAVSLGERATINC (611) | WYQQKPGQPPKMLIY (624) | GVPDRFTGSGSGTDFTLTISSVQAEDVAVYHC (638) | FGQGTKLEIK (643) |
| 44 | DIVMTQSPDSLAVSLGERATINC (611) | WYHQKPGQPPKMLIY (619) | GVPDRFTGSGSGTDFTLTISSVQAEDVAVYYC (639) | FGQGTKLEIK (643) |
| 45 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 46 | DIVMTQSPDSLAVSLGERATINC (611) | WYHQKPGQPPKLLIY (618) | GVPDRFTGSGSGTDFTLTISSLQAEDVAVYHC (636) | FGQGTKLEIK (643) |
| 47 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 48 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 49 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 50 | DIVMTQSPDSLAVSLGERATINC (611) | WYQQKPGQPPKMLIY (624) | GVPDRFSGSGSGTDFTLTISSLQAEDVAVYYC (631) | FGQGTKLEIK (643) |
| 51 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 52 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |
| 53 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |

TABLE 3-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 54 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 55 | DIVMTQSPDSLAVSLGERATINC (611) | WYQQKPGQPPKLLIY (623) | GVPDRFSGSGSGTDFTLTISSVQAEDVAVYHC (632) | FGQGTKLEIK (643) |
| 56 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 57 | DIVMTQSPDSLAVSLGERATINC (611) | WYHQKPGQPPKMLIY (619) | GVPDRFSGSGSGTDFTLTISSLQAEDVAVYHC (630) | FGQGTKLEIK (643) |
| 58 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 59 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 60 | DIVMTQSPDSLAVSLGERATINC (611) | WYHQKPGQPPKLLIY (618) | GVPDRFSGSGSGTDFTLTISSVQAEDVAVYYC (633) | FGQGTKLEIK (643) |
| 61 | DIVMTQSPDSLAVSLGERATINC (611) | WYQQKPGQPPKLLIY (623) | GVPDRFSGSGSGTDFTLTISSVQAEDVAVYYC (633) | FGQGTKLEIK (643) |
| 62 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 63 | DIVMTQSPDSLAVSLGERATINC (611) | WYHQKPGQPPKMLIY (619) | GVPDRFTGSGSGTDFTLTISSVQAEDVAVYHC (638) | FGQGTKLEIK (643) |
| 64 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 65 | DIVMTQSPDSLPVSLGERATINC (612) | WYHQKPGQPPKMLIY (619) | GVPDRFSGSGSGTDFTLTISFVQAEDVAVYYC (628) | FGQGTKLEIK (643) |
| 66 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 67 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 68 | DIVMTQSPDSLAVSLGERATINC (611) | WYHQKPGQPPKMLIY (624) | GVPDRFTGSGSGTDFTLTISSLQAEDVAVYYC (642) | FGQGTKLEIK (643) |
| 69 | DIVMTQSPDSLAVSLGERATINC (611) | WYHQKPGQPPKMLIY (619) | GVPDRFSGSGSGTDFTLTISSVQAEDVAVYYC (633) | FGQGTKLEIK (643) |
| 70 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |
| 71 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 72 | DIVMTQSPDSLAVSLGERATINC (611) | WYHQKPGQPPKLLIY (618) | GVPDRFSGSGSGTDFTLTISSLQAEDVAVYHC (630) | FGQGTKLEIK (643) |
| 73 | DIVMTQSPDSLAVSLGERATINC (611) | WYHQKPGQPPKLLIY (618) | GVPDRFSGSGSGTDFTLTISSLQAEDVAVYHC (630) | FGQGTKLEIK (643) |
| 74 | DIVMTQSPDSLAVSLGERATINC (611) | WYHQKPGQPPKMLIY (619) | GVPDRFSGSGSGTDFTLTISSVQAEDVAVYHC (632) | FGQGTKLEIK (643) |
| 75 | DIVMTQSPDSLAVSLGERATINC (611) | WYHQKPGQPPKLLIY (618) | GVPDRFTGSGSGTDFTLTISSLQAEDVAVYYC (642) | FGQGTKLEIK (643) |
| 76 | DIVMTQSPDSLAVSLGERATINC (611) | WYQQKPGQPPKMLIY (624) | GVPDRFSGSGSGTDFTLTISSVQAEDVAVYHC (632) | FGQGTKLEIK (643) |
| 77 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 78 | DIVMTQSPDSLAVSLGERATINC (611) | WYHQKPGQPPKMLIY (619) | GVPDRFTGSGSGTDFTLTISSVQAEDVAVYHC (638) | FGQGTKLEIK (643) |

TABLE 3-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 79 | DIVMTQSPDSLAVSLGERATINC (611) | WYHQKPGQPPKMLIY (619) | GVPDRFSGSGSGTDFTLTISSLQAEDVAVYYC (631) | FGQGTKLEIK (643) |
| 80 | DIVMTQSPDSLAVSLGERATINC (611) | WYQQKPGQPPKLLIY (623) | GVPDRFTGSGSGTDFTLTISSLQAEDVAVYYC (642) | FGQGTKLEIK (643) |
| 81 | DIVMTQSPDSLSVSLGERATINC (613) | WYQQKPGQPPKLLIY (623) | GVPDRFSGSGSGTDFTLTISSVQAEDVAVYHC (632) | FGQGTKLEIK (643) |
| 82 | DIVMTQSPDSLAVSLGERATINC (611) | WYHQKPGQPPKMLIY (619) | GVPDRFSGSGSGTDFTLTISSLQAEDVAVYYC (631) | FGQGTKLEIK (643) |
| 83 | DIVMTQSPDSLAVSLGERATINC (611) | WYHQKPGQPPKLLIY (618) | GVPDRFSGSGSGTDFTLTISSVQAEDVAVYYC (633) | FGQGTKLEIK (643) |
| 84 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 85 | DIVMTQSPDSLAVSLGERATINC (611) | WYHQKPGQPPKLLIY (618) | GVPDRFSGSGSGTDFTLTISSVQAEDVAVYYC (633) | FGQGTKLEIK (643) |
| 86 | DIVMTQSPDSLAVSLGERATINC (611) | WYHQKPGQPPKLLIY (618) | GVPDRFSGSGSGTDFTLTISSVQAEDVAVYYC (633) | FGQGTKLEIK (643) |
| 87 | DIVMTQSPDSLAVSLGERATINC (611) | WYQQKPGQPPKLLIY (623) | GVPDRFSGSGSGTDFTLTISSVQAEDVAVYHC (632) | FGQGTKLEIK (643) |
| 88 | DIVMTQSPDSLAVSLGERATINC (611) | WYQQKPGQPPKLLIY (623) | GVPDRFSGSGSGTDFTLTISSVQAEDVAVYYC (633) | FGQGTKLEIK (643) |
| 89 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 90 | DIVMTQSPDSLAVSLGERATINC (611) | WYQQKPGQPPKLLIY (618) | GVPDRFTGSGSGTDFTLTISSLQAEDVAVYHC (636) | FGQGTKLEIK (643) |
| 91 | DIVMTQSPDSLAVSLGERATINC (611) | WYQQKPGQPPKLLIY (623) | GVPDRFTGSGSGTDFTLTISSVQAEDVAVYHC (632) | FGQGTKLEIK (643) |
| 92 | DIVMTQSPDSLAVSLGERATINC (611) | WYHQKPGQPPKMLIY (619) | GVPDRFSGSGSGTNFTLTISSVQAEDVAVYHC (635) | FGQGTKLEIK (643) |
| 93 | DIVMTQSPDSLAVSLGERATINC (611) | WYHQKPGQPPKMLIY (619) | GVPDRFTGSGSGTDFTLTISSLQAEDVAVYHC (636) | FGQGTKLEIK (643) |
| 94 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 95 | DIVMTQSPDSLAVSLGERATINC (611) | WYQQKPGQPPKMLIY (624) | GVPDRFSGSGSGTDFTLTISSVQAEDVAVYHC (632) | FGQGTKLEIK (643) |
| 96 | DIVMTQSPDSLAVSLGERATINC (611) | WYHQKPGQPPKLLIY (618) | GVPDRFSGSGSGTDFTLTISSLQAEDVAVYHC (630) | FGQGTKLEIK (643) |
| 97 | DIVMTQSPDSLAVSLGERATINC (611) | WYHQKPGQPPKLLIY (618) | GVPDRFTGSGSGTDFTLTISSVQAEDVAVYHC (638) | FGQGTKLEIK (643) |
| 98 | DIVMTQSPDSLAVSLGERATINC (611) | WYHQKPGQPPKLLIY (618) | GVPDRFTGSGSGTDFTLTISSVQAEDVAVYHC (638) | FGQGTKLEIK (643) |
| 99 | DIVMTQSPDSLAVSLGERATINC (611) | WYQQKPGQPPKMLIY (624) | GVPDRFTGSGSGTDFTLTISSVQAEDVAVYYC (633) | FGQGTKLEIK (643) |
| 100 | DIVMTQSPDSLAVSLGERATINC (611) | WYHQKPGQPPKMLIY (619) | GVPDRFSGSGSGTDFTLTISSVQAEDVAVYHC (632) | FGQGTKLEIK (643) |
| 101 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 102 | DIVMTQSPDSLAVSLGERATINC (611) | WYQQKPGQPPKLLIY (623) | GVPDRFTGSGSGTDFTLTISSVQAEDVAVYYC (639) | FGQGTKLEIK (643) |
| 103 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |

TABLE 3-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 104 | DIVMTQSPDSLAVSLGERATINC (611) | WYHQKPGQPPKLLIY (618) | GVPDRFSGSGSGTDFTLTISSFQAEDVAVYHC (629) | FGQGTKLEIK (643) |
| 105 | DIVMTQSPDSLAVSLGERATINC (611) | WYQQKPGQPPKLLIY (623) | GVPDRFSGSGSGTDFTLTISSVQAEDVAVYYC (633) | FGQGTKLEIK (643) |
| 106 | DIVMTQSPDSLAVSLGERATINC (611) | WYQQKPGQPPKSLIY (625) | GVPDRFSGSGSGTDFTLTISSVQAEDVAVYHC (632) | FGQGTKLEIK (643) |
| 107 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |

[3]The VL framework regions described in Table 3 are determined based upon the boundaries of the Kabat numbering system for CDRs. In other words, the VL CDRs are determined by Kabat and the framework regions are the amino acid residues surrounding the CDRs in the variable region in the format FR1, CDR1, FR2, CDR2, FR3, CDR3, and FR4.

TABLE 4

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 231-32-15 | QVQLLQSGTELVRPGVSVKISCKGSGYTFT (645) | WVKQSHAKSLEWIG (652) | KATMTVDKSSSIAYMELARLSSEDSAIYYCAK (658) | WGQGTLVTVSS (668) |
| Hum231#1 | QVQLVQSGAEVKKPGASVKVSCKGSGYTFT (649) | WVRQAPGQGLEWIG (653) | RATMTVDKSISTAYMELSRLRSDDTAVYYCAK (659) | WGQGTLVTVSS (668) |
| Hum231#2 | QVQLVQSGAEVKKPGASVKVSCKGSGYTFT (649) | WVRQAPGQGLEWIG (653) | RATMTVDKSISTAYMELSRLRSDDTAVYYCAK (659) | WGQGTLVTVSS (668) |
| pab1964 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| pab1965 | QVQLVQSGAEAKKPGASVKVSCKGSGYTFT (646) | WVRQAPGQGMEWIG (655) | RVTMTVDTSISTAYMELSRLRSDDTAVYYCAK (663) | WGQGTLVTVSS (668) |
| pab1966 | QVQLVQSGTEVKKPGASVKVSCKGSGYTFT (651) | WVRQAPGQGLEWIG (653) | RVTMTVDTSISTAYMELSRLRSDDTAVYYCAK (662) | WGQGTLVTVSS (668) |
| pab1967 | QVQLVQSGAEVKKPGASVKVSCKGSGYTFT (649) | WVRQAPGQGLEWMG (654) | RATMTVDTSISTAYMELSRLRSDDTAVYYCAK (670) | WGQGTLITVS (667) |
| pab1968 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| pab1969 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1970 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| pab1971 | QVQLVQSGTEVKKPGASVKVSCKGSGYTFT (651) | WVRQAPGQGMEWMG (656) | RVTMTVDTSISTAYMELSRLRSDDTAVYYCAK (663) | WGQGTLVTVSS (668) |
| pab1972 | QVQLVQSGAEVKKPGASVKVSCKASGYTFT (648) | WVRQAPGQGLEWMG (654) | RVTMTVDKSISTAYMELSRLRSDDTAVYYCAK (662) | WGQGTLVTVSS (668) |

TABLE 4-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| pab1973 | QVQLVQSGAEVKKPGASVKVSCKASGYTFT (648) | WVRQAPGQGMEWMG (656) | RATMTVDTSISTAYMELSRLRSDDTAVYYCAK (670) | WGQGTLVTVSS (668) |
| pab1975 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1976 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1977 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1979 | QVQLVQSGAEVKKPGASVKVSCKASGYTFT (648) | WVRQAPGQGLEWMG (654) | RVTMTVDTSISTAYMELSRLRSDDTAVYYCAK (663) | WGQGTLVTVSS (668) |
| pab1980 | QVQLVQSGAEVKKPGASVKVSCKASGYTFT (648) | WVRQAPGQGLEWMG (654) | RVTMTVDTSISTAYMELSRLRSDDTAVYYCAK (663) | WGQGTLVTVSS (668) |
| pab1981 | QVQLVQSGAEVKKPGASVKVSCKASGYTFT (648) | WVRQAPGQGLEWMG (654) | RVTMTVDTSISTAYMELSRLRSDDTAVYYCAK (663) | WGQGTLVTVSS (668) |
| pab1983 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| pab2159 | QVQLVQSGAEVKKPGASVKVSCKASGYTFT (648) | WVRQAPGQGLEWMG (654) | RATMTVDKSISTAYMELSRLRSDDTAVYYCAK (659) | WGQGTLVTVSS (668) |
| pab2160 | QVQLVQSGTEVKKPGASVKVSCKGSGYTFT (651) | WVRQAPGQGMEWIG (655) | RVTMTVDTSISTAYMELSRLRSDDTAVYYCAK (663) | WGQGTLVTVSS (668) |
| pab2161 | QVQLVQSGAEVKKPGASVKVSCKGSGYTFT (649) | WVRQAPGQGLEWIG (653) | RATMTVDTSISTAYMELSRLRSDDTAVYYCAK (670) | WGQGTLVTVSS (668) |
| 1 | QVQLVQSGTEVKKPGASVKVSCKGSGYTFT (651) | WVRQAPGQGLEWIG (653) | RATMTVDTSISTAYMELSRLRSDDTAVYYCAK (670) | WGQGTLVTVSS (668) |
| 2 | QVQLVQSGAEVKKPGASVKVSCKASGYTFT (648) | WVRQAPGQGMEWIG (655) | RATMTVDKSISTAYMELSRLRSDDTAVYYCAK (659) | WGQGTLVTVSS (668) |
| 3 | QVQLVQSGAEVKKPGASVKVSCKGSGYTFT (649) | WVRQAPGQGMEWMG (656) | RVTMTVDKSISTAYMELSRLRSDDTAVYYCAK (662) | WGQGTLVTVSS (668) |
| 4 | QVQLVQSGAEVKKPGASVKVSCKASGYTFT (648) | WVRQAPGQSLEWMG (657) | RVTMTVDKSISTAYMELSRLRSDDTAVYYCAK (662) | WGQGTLVTVSS (668) |
| 5 | QVQLVQSGAEVKKPGASVKVSCKGSGYTFT (649) | WVRQAPGQGLEWMG (654) | RVTMTVDTSISTAYMELSRLRSDDTAVYYCAK (663) | WGQGTLVTVSS (668) |
| 6 | QVQLVQSGAEVKKPGASVKVSCKGSGYTFT (649) | WVRQAPGQGLEWMG (654) | RATMTVDTSISTAYMELSRLRSDDTAVYYCAK (670) | WGQGTLVTVSS (668) |
| 7 | QVQLVQSGAEVKKPGASVKVSCKASGYTFT (648) | WVRQAPGQGMEWMG (656) | RVTMTVDTSISTAYMELSRLRSDDTAVYYCAK (663) | WGQGTLVTVSS (668) |

TABLE 4-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 8 | QVQLVQSGAEVKKPGASVKVSCKGSGYTFT (649) | WVRQAPGQGLEWMG (654) | RVTMTVDKSISTAYMELSRLRSDDTAVYYCAK (662) | WGQGTLVTVSS (668) |
| 9 | QVQLVQSGAEVKKPGASVKVSCKASGYTFT (648) | WVRQAPGQGLEWMG (654) | RATMTVDKSISTAYMELSRLRSDDTAVYYCAK (659) | WGQGTLVTVSS (668) |
| 10 | QVQLVQSGAEVKKPGASVKVSCKASGYTFT (648) | WVRQAPGQGLEWMG (654) | RVTMTVDKSISTAYMELSRLRSDDTAVYYCAK (662) | WGQGTLVTVSS (668) |
| 11 | QVQLVQSGAEVKKPGASVKVSCKGSGYTFT (649) | WVRQAPGQGLEWMG (654) | RVTMTVDTSISTAYMELSRLRSDDTAVYYCAK (663) | WGQGTLVTVSS (668) |
| 12 | QVQLVQSGAEVKKPGASVKVSCKGSGYTFT (649) | WVRQAPGQGLEWIG (653) | RVTMTVDTSISTAYMELSRLRSDDTAVYYCAK (663) | WGQGTLVTVSS (668) |
| 13 | QVQLVQSGAEVKKPGASVKVSCKASGYTFT (648) | WVRQAPGQGLEWMG (654) | RATMTVDKSISTAYMELSRLRSDDTAVYYCAK (659) | WGQGTLVTVSS (668) |
| 14 | QVQLVQSGTEVKKPGASVKVSCKGSGYTFT (651) | WVRQAPGQGLEWMG (654) | RATMTVDTSISTAYMELSRLRSDDTAVYYCAK (670) | WGQGTLVTVSS (668) |
| 15 | QVQLVQSGAEVKKPGASVKVSCKGSGYTFT (649) | WVRQAPGQGLEWIG (653) | RATMTVDKSISTAYMELSRLRSDDTAVYYCAK (659) | WGQGTLVTVSS (668) |
| 16 | QVQLVQSGTEVKKPGASVKVSCKASGYTFT (650) | WVRQAPGQGLEWIG (653) | RVTMTVDKSISTAYMELSRLRSDDTAVYYCAK (662) | WGQGTLVTVSS (668) |
| 17 | QVQLVQSGAEVKKPGASVKVSCKASGYTFT (648) | WVRQAPGQGLEWMG (654) | RATMTVDKSISTAYMELSRLRSDDTAVYYCAK (659) | WGQGTLVTVSS (668) |
| 18 | QVQLVQSGTEVKKPGASVKVSCKASGYTFT (650) | WVRQAPGQGMEWIG (655) | RVTMTVDTSISTAYMELSRLRSDDTAVYYCAK (663) | WGQGTLVTVSS (668) |
| 19 | QVQLVQSGAEVKKPGASVKVSCKGSGYTFT (649) | WVRQAPGQGLEWMG (654) | RATMTVDTSISTAYMELSRLRSDDTAVYYCAK (670) | WGQGTLVTVSS (668) |
| 20 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| 21 | QVQLVQSGTEVKKPGASVKVSCKGSGYTFT (651) | WVRQAPGQGMEWIG (655) | RVTMTVDTSISTAYMELSRLRSDDTAVYYCAK (663) | WGQGTLVTVSS (668) |
| 22 | QVQLVQSGAEVKKPGASVKVSCKASGYTFT (648) | WVRQAPGQGMEWIG (655) | RATMTVDTSISTAYMELSRLRSDDTAVYYCAK (670) | WGQGTLVTVSS (668) |
| 23 | QVQLVQSGTEVKKPGASVKVSCKGSGYTFT (651) | WVRQAPGQGMEWIG (655) | RATMTVDKSISTAYMELSRLRSDDTAVYYCAK (659) | WGQGTLVTVSS (668) |
| 24 | QVQLVQSGAEVKKPGASVKASCKGSGYTFT (647) | WVRQAPGQGMEWIG (655) | RVTMTVDKSISTAYMELSRLRSDDTAVYYCAK (662) | WGQGTLVTVSS (668) |
| 25 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |

TABLE 4-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 26 | QVQLVQSGTEVKKPGASVKVSCKGSGYTFT (651) | WVRQAPGQGMEWMG (656) | RVTMTVDKSISTAYMELSRLRSDDTAVYYCAK (662) | WGQGTLVTVSS (668) |
| 27 | QVQLVQSGTEVKKPGASVKVSCKGSGYTFT (651) | WVRQAPGQGMEWMG (656) | RVTMTVDTSISTAYMELSRLRSDDTAVYYCAK (663) | WGQGTLVTVSS (668) |
| 28 | QVQLVQSGTEVKKPGASVKVSCKGSGYTFT (651) | WVRQAPGQGLEWIG (653) | RATMTVDKSISTAYMELSRLRSDDTAVYYCAK (659) | WGQGTLVTVSS (668) |
| 29 | QVQLVQSGAEVKKPGASVKVSCKGSGYTFT (649) | WVRQAPGQGLEWIG (653) | RATMTVDTSISTAYMELSRLRSDDTAVYYCAK (670) | WGQGTLVTVSS (668) |
| 30 | QVQLVQSGAEVKKPGASVKVSCKGSGYTFT (649) | WVRQAPGQGLEWMG (654) | RVTMTVDTSISTAYMELSRLRSDDTAVYYCAK (663) | WGQGTLVTVSS (668) |
| 31 | QVQLVQSGTEVKKPGASVKVSCKGSGYTFT (651) | WVRQAPGQGLEWMG (654) | RVTMTVDKSISTAYMELSRLRSDDTAVYYCAK (662) | WGQGIPVTVSS (664) |
| 32 | QVQLVQSGAEVKKPGASVKVSCKASGYTFT (648) | WVRQAPGQGMEWMG (656) | RATMTVDKSISTAYMELSRLRSDDTAVYYCAK (659) | WGQGTLVTVSS (668) |
| 33 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| 34 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| 35 | QVQLVQSGAEAKKPGASVKVSCKGSGYTFT (646) | WVRQAPGQGMEWIG (655) | RVTMTVDTSISTAYMELSRLRSDDTAVYYCAK (663) | WGQGTLVTVSS (668) |
| 36 | QVQLVQSGAEVKKPGASVKVSCKGSGYTFT (649) | WVRQAPGQGMEWIG (655) | RVTMTVDKSISTAYMELSRLRSDDTAVYYCAK (662) | WGQGTLVTVSS (668) |
| 37 | QVQLVQSGTEVKKPGASVKVSCKGSGYTFT (651) | WVRQAPGQGMEWIG (655) | RVTMTVDTSISTAYMELSRLRSDDTAVYYCAK (663) | WGQGTLVTVSS (668) |
| 38 | QVQLVQSGTEVKKPGASVKVSCKGSGYTFT (651) | WVRQAPGQGLEWIG (653) | RVTMTVDKSISTAYMELSRLRSDDTAVYYCAK (662) | WGQGTLVTVSS (668) |
| 39 | QVQLVQSGAEVKKPGASVKVSCKGSGYTFT (649) | WVRQAPGQGLEWMG (654) | RATMTVDTSISTAYMELSRLRSDDTAVYYCAK (670) | WGQGTLITVSS (667) |
| 40 | QVQLVQSGAEVKKPGASVKVSCKASGYTFT (648) | WVRQAPGQGLEWIG (653) | RVTMTVDKSISTAYMELSRLRSDDTAVYYCAK (662) | WGQGTLVTVSS (668) |
| 41 | QVQLVQSGAEVKKPGASVKVSCKGSGYTFT (649) | WVRQAPGQGLEWMG (654) | RVTMTVDKSISTAYMELSRLRSDDTAVYYCAK (659) | WGQGTLVTVSS (668) |
| 42 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| 43 | QVQLVQSGAEVKKPGASVKVSCKGSGYTFT (649) | WVRQAPGQGMEWIG (655) | RATMTVDKSISTAYMELSRLRSDDTAVYYCAK (659) | WGQGTLVTVSS (668) |

TABLE 4-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 44 | QVQLVQSGTEVKKPGASVKVSCKGSGYTFT (651) | WVRQAPGQGLEWMG (654) | RATMTVDTSISTAYMELSRLRSDDTAVYYCAK (670) | WGQGTLVTVSS (668) |
| 45 | QVQLVQSGAEVKKPGASVKVSCKGSGYTFT (649) | WVRQAPGQGLEWIG (653) | RVTMTVDTSISTAYMELSRLRSDDTAVYYCAK (663) | WGQGTFVTVSS (665) |
| 46 | QVQLVQSGAEVKKPGASVKVSCKASGYTFT (648) | WVRQAPGQGLEWMG (654) | RVTMTVDTSISTAYMELSRLRSDDTAVYYCAK (663) | WGQGTLVTVSS (668) |
| 47 | QVQLVQSGAEVKKPGASVKVSCKASGYTFT (648) | WVRQAPGQGMEWMG (656) | RVTMTVDKSISTAYMELSRLRSDDTAVYYCAK (662) | WGQGTLVTVSS (668) |
| 48 | QVQLVQSGAEVKKPGASVKVSCKASGYTFT (648) | WVRQAPGQGLEWMG (654) | RATMTVDKSISTAYMELSRLRSDDTAVYYCAK (659) | WGQGTLVTVSS (668) |
| 49 | QVQLVQSGTEVKKPGASVKVSCKGSGYTFT (651) | WVRQAPGQGLEWMG (654) | RATMTVDTSISTAYMELSRLRSDDTAVYYCAK (670) | WGQGTLVTVSS (668) |
| 50 | QVQLVQSGTEVKKPGASVKVSCKASGYTFT (650) | WVRQAPGQGLEWIG (653) | RVTMTVDKSISTAYMELSRLRSDDTAVYYCAK (662) | WGQGTLVTVSS (668) |
| 51 | QVQLVQSGTEVKKPGASVKVSCKASGYTFT (650) | WVRQAPGQGLEWMG (654) | RATMTVDTSISTAYMELSRLRSDDTAVYYCAK (670) | WGQGTLVTVSS (668) |
| 52 | QVQLVQSGTEVKKPGASVKVSCKGSGYTFT (651) | WVRQAPGQGLEWMG (654) | RVTMTVDKSISTAYMELSRLRSDDTAVYYCAK (662) | WGQGTLVTVSS (668) |
| 53 | QVQLVQSGTEVKKPGASVKVSCKASGYTFT (650) | WVRQAPGQGMEWMG (656) | RATMTVDKSISTAYMELSRLRSDDTAVYYCAK (659) | WGQGTLVTVSS (668) |
| 54 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| 55 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| 56 | QVQLVQSGTEVKKPGASVKVSCKGSGYTFT (651) | WVRQAPGQGMEWMG (656) | RVTMTVDTSISTAYMELSRLRSDDTAVYYCAK (663) | WGQGTLVTVSS (668) |
| 57 | QVQLVQSGTEVKKPGASVKVSCKGSGYTFT (651) | WVRQAPGQGMEWIG (655) | RVTMTVDTSISTAYMELSRLRSDDTAVYYCAK (663) | WGQGTLVTVSS (668) |
| 58 | QVQLVQSGAEVKKPGASVKVSCKGSGYTFT (649) | WVRQAPGQGLEWMG (654) | RATMTVDKSISTAYMELSRLRSDDTAVYYCAK (659) | WGQGTLVTVSS (668) |
| 59 | QVQLVQSGAEVKKPGASVKVSCKASGYTFT (648) | WVRQAPGQGLEWMG (654) | RVTMTVDKSISTAYMELSRLRSDDTAVYYCAK (662) | WGQGTLVTVSS (668) |
| 60 | QVQLVQSGAEVKKPGASVKVSCKGSGYTFT (649) | WVRQAPGQGLEWMG (654) | RATMTVDKSISTAYMELSRLRSDDTAVYYCAK (659) | WGQGTLVTVSS (668) |
| 61 | QVQLVQSGTEVKKPGASVKVSCKASGYTFT (650) | WVRQAPGQGLEWMG (654) | RVTMTVDKSISTAYMELSRLRSDDTAVYYCAK (662) | WGQGTLVTVSS (668) |

TABLE 4-continued

| | VH FR Amino Acid Sequences[4] | | | |
|---|---|---|---|---|
| Antibody | VH FR1 (SEQ ID NO:) | VH FR2 (SEQ ID NO:) | VH FR3 (SEQ ID NO:) | VH FR4 (SEQ ID NO:) |
| 62 | QVQLVQSGAEVKKPGASVKVSCKGSGYTFT (649) | WVRQAPGQGMEWMG (656) | RATMTVDKSISTAYMELSRLRSDDTAVYYCAK (659) | WGQGTLVTVSS (668) |
| 63 | QVQLVQSGAEVKKPGASVKVSCKASGYTFT (648) | WVRQAPGQGLEWIG (653) | RVTMTVDKSISTAYMELSRLRSDDTAVYYCAK (662) | WGQGTLVTVSS (668) |
| 64 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| 65 | QVQLVQSGAEVKKPGASVKVSCKGSGYTFT (649) | WVRQAPGQGLEWMG (654) | RVTMTVDKSISTAYMELSRLRSDDTAVYYCAK (662) | WGQGTLVTVSS (668) |
| 66 | QVQLVQSGTEVKKPGASVKVSCKGSGYTFT (651) | WVRQAPGQGLEWMG (654) | RVTMTVDTSISTAYMELSRLRSDDTAVYYCAK (663) | WGQGTLVTVSS (668) |
| 67 | QVQLVQSGAEVKKPGASVKVSCKGSGYTFT (649) | WVRQAPGQGLEWMG (654) | RVTMTVDKSISTAYMELSRLRSDDTAVYYCAK (662) | WGQGTLVTVSS (668) |
| 68 | QVQLVQSGTEVKKPGASVKVSCKGSGYTFT (651) | WVRQAPGQGLEWIG (653) | RVTMTVDTSISTAYMELSRLRSDDTAVYYCAK (663) | WGQGTLVTVSS (668) |
| 69 | QVQLVQSGTEVKKPGASVKVSCKGSGYTFT (651) | WVRQAPGQGMEWMG (656) | RATMTVDTSISTAYMELSRLRSDDTAVYYCAK (670) | WGQGTLVTVSS (668) |
| 70 | QVQLVQSGTEVKKPGASVKVSCKASGYTFT (650) | WVRQAPGQGMEWIG (655) | RATMTVDTSISTAYMELSRLRSDDTAVYYCAK (670) | WGQGTLVTVSS (668) |
| 71 | QVQLVQSGAEVKKPGASVKVSCKASGYTFT (648) | WVRQAPGQGMEWMG (656) | RATMTVDTSISTAYMELSRLRSDDTAVYYCAK (670) | WGQGTLVTVSS (668) |
| 72 | QVQLVQSGAEVKKPGASVKVSCKGSGYTFT (649) | WVRQAPGQGLEWMG (654) | RATMTVDTSISTAYMELSRLRSDDTAVYYCAK (670) | WGQGTLVTVSS (668) |
| 73 | QVQLVQSGAEVKKPGASVKVSCKGSGYTFT (649) | WVRQAPGQGMEWIG (655) | RVTMTVDKSISTAYMELSRLRSDDTAVYYCAK (662) | WGQGTLVTVSS (668) |
| 74 | QVQLVQSGTEVKKPGASVKVSCKGSGYTFT (651) | WVRQAPGQGMEWIG (655) | RATMTVDTSISTAYMELSRLRSDDTAVYYCAK (670) | WGQGTLVTVSS (668) |
| 75 | QVQLVQSGTEVKKPGASVKVSCKGSGYTFT (651) | WVRQAPGQGLEWIG (653) | RVTMTVDKSISTAYMELSRLRSDDTAVYYCAK (662) | WGQGTLVTVSS (668) |
| 76 | QVQLVQSGAGVKKPGASVKVSCKGSGYTFT (644) | WVRQAPGQGLEWMG (654) | RATMTVDKSISTAYMELSRLRSDDTAVYYCAK (659) | WGQGTLVTVSS (668) |
| 77 | QVQLVQSGAEVKKPGASVKVSCKGSGYTFT (649) | WVRQAPGQGLEWIG (653) | RATMTVDTSISTAYMELSRLRSDDTAVYYCAK (670) | WGQGTLVTVSS (668) |
| 78 | QVQLVQSGAEVKKPGASVKVSCKGSGYTFT (649) | WVRQAPGQGLEWIG (653) | RATMTVDTSISTAYMELSRLRGDDTAVYYCAK (661) | WGRGTLVTVSS (669) |

TABLE 4-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 79 | QVQLVQSGTEVKKPGASVKVSCKGSGYTFT (651) | WVRQAPGQGMEWMG (656) | RVTMTVDKSISTAYMELSRLRSDDTAVYYCAK (662) | WGQGTLVTVSS (668) |
| 80 | QVQLVQSGTEVKKPGASVKVSCKASGYTFT (650) | WVRQAPGQGMEWMG (656) | RVTMTVDTSISTAYMELSRLRSDDTAVYYCAK (663) | WGQGTLVTVSS (668) |
| 81 | QVQLVQSGTEVKKPGASVKVSCKASGYTFT (650) | WVRQAPGQGLEWMG (654) | RATMTVDTSISTAYMELSRLRSDDTAVYYCAK (670) | WGQGTLVTVSS (668) |
| 82 | QVQLVQSGAEVKKPGASVKVSCKGSGYTFT (649) | WVRQAPGQGMEWMG (656) | RVTMTVDKSISTAYMELSRLRSDDTAVYYCAK (662) | WGQGTLVTVSS (668) |
| 83 | QVQLVQSGAEVKKPGASVKVSCKGSGYTFT (649) | WVRQAPGQGMEWMG (656) | RVTMTVDTSISTAYMELSRLRSDDTAVYYCAK (663) | WGQGTLVTVSS (668) |
| 84 | QVQLVQSGTEVKKPGASVKVSCKGSGYTFT (651) | WVRQAPGQGMEWMG (656) | RATMTVDTSISTAYMELSRLRSDDTAVYYCAK (670) | WGQGTLVTVSS (668) |
| 85 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| 86 | QVQLVQSGAEVKKPGASVKVSCKASGYTFT (649) | WVRQAPGQGMEWMG (656) | RATMTVDTSISTAYMELSRLRSDDTAVYYCAK (670) | WGQGTLVTVSS (668) |
| 87 | QVQLVQSGAEVKKPGASVKVSCKGSGYTFT (649) | WVRQAPGQGMEWIG (655) | RATMTVDTSISTAYMELSRLRSDDTAVYYCAK (670) | WGQGTLVTVSS (668) |
| 88 | QVQLVQSGAEVKKPGASVKVSCKGSGYTFT (649) | WVRQAPGQGLEWMG (654) | RATMTVDKSISTAYMELSRLRSDDTAVYYCAK (659) | WGQGTLVTVSS (668) |
| 89 | QVQLVQSGTEVKKPGASVKVSCKASGYTFT (650) | WVRQAPGQGMEWMG (656) | RVTMTVDKSISTAYMELSRLRSDDTAVYYCAK (662) | WGQGTLVTVSS (668) |
| 90 | QVQLVQSGAEVKKPGASVKVSCKASGYTFT (648) | WVRQAPGQGLEWIG (653) | RATMTVDTSISTAYMELSRLRSDDTAVYYCAK (670) | WGQGTLVTVSS (668) |
| 91 | QVQLVQSGTEVKKPGASVKVSCKGSGYTFT (651) | WVRQAPGQGMEWMG (656) | RATMTVDTSISTAYMELSRLRSDDTAVYYCAK (670) | WGQGTLVTVSS (668) |
| 92 | QVQLVQSGAEVKKPGASVKVSCKGSGYTFT (649) | WVRQAPGQGLEWMG (654) | RATMTVDTSISTAYMELSRLQSDDTAVYYCAK (660) | WGQGTLVTVSS (668) |
| 93 | QVQLVQSGTEVKKPGASVKVSCKASGYTFT (650) | WVRQAPGQGMEWMG (656) | RVTMTVDKSISTAYMELSRLRSDDTAVYYCAK (662) | WGQGTLVTVSS (668) |
| 94 | QVQLVQSGTEVKKPGASVKVSCKGSGYTFT (651) | WVRQAPGQGLEWIG (653) | RVTMTVDKSISTAYMELSRLRSDDTAVYYCAK (662) | WGQGTFVTVSS (666) |
| 95 | QVQLVQSGAEVKKPGASVKVSCKASGYTFT (649) | WVRQAPGQGLEWMG (654) | RVTMTVDTSISTAYMELSRLRSDDTAVYYCAK (663) | WGQGTFVTVSS (666) |
| 96 | QVQLVQSGAEVKKPGASVKVSCKGSGYTFT (649) | WVRQAPGQGMEWMG (656) | RVTMTVDTSISTAYMELSRLRSDDTAVYYCAK (663) | WGQGTLVTVSS (668) |

TABLE 4-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 97 | QVQLVQSGTEVKKPGASVKVSCKGSGYTFT (651) | WVRQAPGQGMEWIG (655) | RVTMTVDKSISTAYMELSRLRSDDTAVYYCAK (662) | WGQGTLVTVSS (668) |
| 98 | QVQLVQSGAEVKKPGASVKVSCKGSGYTFT (649) | WVRQAPGQGMEWMG (656) | RATMTVDTSISTAYMELSRLRSDDTAVYYCAK (670) | WGQGTLVTVSS (668) |
| 99 | QVQLVQSGAEVKKPGASVKVSCKASGYTFT (648) | WVRQAPGQGMEWMG (656) | RVTMTVDKSISTAYMELSRLRSDDTAVYYCAK (662) | WGQGTLVTVSS (668) |
| 100 | QVQLVQSGTEVKKPGASVKVSCKASGYTFT (650) | WVRQAPGQGMEWMG (656) | RATMTVDTSISTAYMELSRLRSDDTAVYYCAK (670) | WGQGTLVTVSS (668) |
| 101 | QVQLVQSGAEVKKPGASVKVSCKASGYTFT (648) | WVRQAPGQGLEWMG (654) | RVTMTVDKSISTAYMELSRLRSDDTAVYYCAK (662) | WGQGTLVTVSS (668) |
| 102 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| 103 | QVQLVQSGAEVKKPGASVKVSCKASGYTFT (648) | WVRQAPGQGMEWMG (656) | RVTMTVDTSISTAYMELSRLRSDDTAVYYCAK (663) | WGQGTLVTVSS (668) |
| 104 | QVQLVQSGTEVKKPGASVKVSCKGSGYTFT (651) | WVRQAPGQGMEWMG (656) | RVTMTVDTSISTAYMELSRLRSDDTAVYYCAK (663) | WGQGTLVTVSS (668) |
| 105 | QVQLVQSGAEVKKPGASVKVSCKGSGYTFT (649) | WVRQAPGQGLEWMG (654) | RVTMTVDTSISTAYMELSRLRSDDTAVYYCAK (663) | WGQGTLVTVSS (668) |
| 106 | QVQLVQSGTEVKKPGASVKVSCKGSGYTFT (651) | WVRQAPGQGLEWIG (653) | RATMTVDKSISTAYMELSRLRSDDTAVYYCAK (659) | WGQGTLVTVSS (668) |
| 107 | QVQLVQSGAEVKKPGASVKVSCKGSGYTFT (649) | WVRQAPGQGLEWMG (654) | RVTMTVDTSISTAYMELSRLRSDDTAVYYCAK (663) | WGQGTLVTVSS (668) |

[4]The VH framework regions described in Table 4 are determined based upon the boundaries of the Kabat numbering system for CDRs. In other words, the VH CDRs are determined by Kabat and the framework regions are the amino acid residues surrounding the CDRs in the variable region in the format FR1, CDR1, FR2, CDR2, FR3, CDR3, and FR4.

In a particular embodiment, an antibody or fragment thereof described herein, which specifically binds to GITR (e.g., human GITR), comprises a light chain variable region (VL) comprising:

(a) a VL CDR1 comprising, consisting of, or consisting essentially of the amino acid sequence KSSQSX$_1$X$_2$X$_3$X$_4$X$_5$X$_6$X$_7$KX$_8$YLX$_9$ (SEQ ID NO: 4), wherein:

X$_1$ is L, A, V, I, P, F or M
X$_2$ is L, A, V, I, P, F, M or S
X$_3$ is N, G, Q, S, T, C, W, Y or A
X$_4$ is S, G, N, Q, T, C, W, Y or A
X$_5$ is G, N, Q, S, T, C, W, Y or A
X$_6$ is N, G, Q, S, T, C, W, Y or A
X$_7$ is Q, G, N, S, T, C, W, Y or A
X$_8$ is N, G, Q, S, T, C, W, Y or A
X$_9$ is T, G, N, Q, S, C, W, Y, V, I or A; and/or (b) a VL CDR2 comprising, consisting of, or consisting essentially of the amino acid sequence X$_1$ASTRX$_2$X$_3$ (SEQ ID NO: 5), wherein:

X$_1$ is W, G, N, Q, S, T, C, Y, F, H or A
X$_2$ is E, D or A
X$_3$ is S, G, N, Q, T, C, W, Y or A; and/or (c) a VL CDR3 comprising, consisting of, or consisting essentially of the amino acid sequence QX$_1$X$_2$YX$_3$X$_4$PYT (SEQ ID NO: 6), wherein:

X$_1$ is N, G, Q, S, T, C, W or Y
X$_2$ is D, E or Y
X$_3$ is S, G, N, Q, T, C, W, Y or A
X$_4$ is Y, G, N, Q, S, T, C, W, F, H, L, or A.

In specific embodiments, the antibody or antigen-binding fragment thereof comprises one, two, or all three of the VL CDRs above. In certain embodiments, the antibody or antigen-binding fragment thereof comprises the VL CDR1 of one of the antibodies in Table 5. In some embodiments, the antibody or antigen-binding fragment thereof comprises the VL CDR2 of one of the antibodies in Table 5. In certain embodiments, the antibody or antigen-binding fragment thereof comprises the VL CDR3 of one of the antibodies in Table 5. In certain embodiments, the antibody or antigen-binding fragment thereof comprises one, two or all three of the VL CDRs of one of the antibodies in Table 5 (e.g., the VL CDRs in one row of Table 5, for example, all of the VL CDRs are from antibody 231-32-15). In some embodiments, the antibody or antigen-binding fragment thereof comprises the VL framework regions described herein. In specific embodiments, the antibody or antigen-binding fragment thereof comprises the VL framework regions (FRs) of an antibody set forth in Table 7 (e.g., one, two, three, or four of the framework regions in one row of Table 7).

In another embodiment, an antibody described herein, or an antigen-binding fragment thereof, which specifically binds to GITR (e.g., human GITR), comprises a heavy chain variable region (VH) comprising:

(a) a VH CDR1 comprising, consisting of, or consisting essentially of the amino acid sequence $X_1YX_2MX_3$ (SEQ ID NO: 1), wherein
$X_1$ is D, E, G or A
$X_2$ is A, V, L, I, P, F, M or Y
$X_3$ is Y, G, N, Q, S, T, C, W, F or H; and/or (b) a VH CDR2 comprising, consisting of, or consisting essentially of the amino acid sequence $X_1IX_2X_3X_4SGX_5X_6X_7YX_8QKFX_9X_{10}$ (SEQ ID NO: 2), wherein
$X_1$ is V, A, L, I, P, F, M or T
$X_2$ is R, K, H, Q or A
$X_3$ is T, G, N, Q, S, C, W, Y, V, I or P
$X_4$ is Y, G, N, Q, S, T, C, W, F, H, or A
$X_5$ is D, E, G or A
$X_6$ is V, A, L, I, P, F, M or T
$X_7$ is T, G, N, Q, S, C, W, Y, V, I, P or A
$X_8$ is N, G, Q, S, T, C, W, Y or A
$X_9$ is K, R, H, Q or A
$X_{10}$ is D, E, G or A; and/or (c) a VH CDR3 comprising, consisting of, or consisting essentially of the amino acid sequence $SGTVRGX_1X_2X_3$ (SEQ ID NO: 3), wherein
$X_1$ is F, A, V, L, I, P, M, Y, W, H or S
$X_2$ is A, or D
$X_3$ is Y, G, N, Q, S, T, C, W, F, H or V.

In specific embodiments, the antibody or antigen-binding fragment thereof comprises one, two or all three of the VH CDRs above. In certain embodiments, the antibody or antigen-binding fragment thereof comprises the VH CDR1 of one of the antibodies in Table 6. In some embodiments, the antibody or antigen-binding fragment thereof comprises the VH CDR2 of one of the antibodies in Table 6. In certain embodiments, the antibody or antigen-binding fragment thereof comprises the VH CDR3 of one of the antibodies in Table 6. In some embodiments, the antibody or antigen-binding fragment thereof comprises one, two or all three of VH CDRs of one of the antibodies in Table 6 (e.g., the VH CDRs in one row of Table 6, for example, all of the VH CDRs are from the antibody 231-32-15). In some embodiments, the antibody or antigen-binding fragment thereof comprises the VH frameworks described herein. In specific embodiments, the antibody or antigen-binding fragment thereof comprises the VH framework regions of an antibody set forth in Table 8 (e.g., one, two, three or four of the framework regions in one row of Table 8).

TABLE 5

VL CDR Amino Acid Sequences[1]

| Antibody | VL CDR1 (SEQ ID NO:) | VL CDR2 (SEQ ID NO:) | VL CDR3 (SEQ ID NO:) |
| --- | --- | --- | --- |
| 231-32-15 | KSSQSLLNSGNQKNYLT (16) | WASTRES (17) | QNDYSYPYT (18) |
| Hum231#1 | KSSQSLLNSGNQKNYLT (16) | WASTRES (17) | QNDYSYPYT (18) |
| Hum231#2 | KSSQSLLNSGNQKNYLT (16) | WASTRES (17) | QNDYSYPYT (18) |
| pab1964 | KSSQSLLNSGNQKNYLS (101) | WASTRES (105) | QNEYSYPYT (106) |
| pab1965 | KSSQSLLNSGNQKNYLT (102) | WASTRES (105) | QNDYSYPYT (107) |
| pab1966 | KSSQSLLNSGNQKNYLT (102) | WASTRES (105) | QNDYSYPYT (107) |
| pab1967 | KSSQSLLNSSNQKNYLT (103) | WASTRES (105) | QNEYSFPYT (108) |
| pab1968 | KSSQSLLNSGNQKNYLS (101) | WASTRES (105) | QNDYSYPYT (107) |
| pab1969 | KSSQSLLNSSNQKNYLT (103) | WASTRES (105) | QNDYSFPYT (109) |
| pab1970 | KSSQSLLNSGNQKNYLS (101) | WASTRES (105) | QNDYSFPYT (109) |
| pab1971 | KSSQSLLNSSNQKNYLT (103) | WASTRES (105) | QNDYSYPYT (107) |
| pab1972 | KSSQSLLNSSNQKNYLS (104) | WASTRES (105) | QNDYSYPYT (107) |
| pab1973 | KSSQSLLNSSNQKNYLT (103) | WASTRES (105) | QNDYSYPYT (107) |
| pab1975 | KSSQSLLNSGNQKNYLT (102) | WASTRES (105) | QNDYSYPYT (107) |
| pab1976 | KSSQSLLNSGNQKNYLS (101) | WASTRES (105) | QNDYSYPYT (107) |
| pab1977 | KSSQSLLNSSNQKNYLT (103) | WASTRES (105) | QNDYSYPYT (107) |
| pab1979 | KSSQSLLNSGNQKNYLT (102) | WASTRES (105) | QNDYSYPYT (107) |
| pab1980 | KSSQSLLNSGNQKNYLS (101) | WASTRES (105) | QNDYSYPYT (107) |
| pab1981 | KSSQSLLNSSNQKNYLT (103) | WASTRES (105) | QNDYSYPYT (107) |

TABLE 5-continued

| Antibody | VL CDR1 (SEQ ID NO:) | VL CDR2 (SEQ ID NO:) | VL CDR3 (SEQ ID NO:) |
|---|---|---|---|
| pab1983 | KSSQSLLNSGNQKNYLT (102) | WASTRES (105) | QNDYSYPYT (107) |
| pab2159 | KSSQSLLNSGNQKNYLT (102) | WASTRES (105) | QNDYSFPYT (109) |
| pab2160 | KSSQSLLNSGNQKNYLT (102) | WASTRES (105) | QNDYSYPYT (107) |
| pab2161 | KSSQSLLNSSNQKNYLT (103) | WASTRES (105) | QNDYSFPYT (109) |
| 1 | KSSQSLLNSGNQKNYLT (102) | WASTRES (105) | QNDYSYPYT (107) |
| 2 | KSSQSLLNSGNQKNYLS (101) | WASTRES (105) | QNEYSFPYT (108) |
| 4 | KSSQSLLNSSNQKNYLS (104) | WASTRES (105) | QNDYSYPYT (107) |
| 5 | KSSQSLLNSSNQKNYLT (103) | WASTRES (105) | QNEYSFPYT (108) |
| 6 | KSSQSLLNSGNQKNYLS (101) | WASTRES (105) | QNDYSYPYT (107) |
| 9 | KSSQSLLNSGNQKNYLT (102) | WASTRES (105) | QNDYSFPYT (109) |
| 10 | KSSQSLLNSSNQKNYLS (104) | WASTRES (105) | QNDYSYPYT (107) |
| 11 | KSSQSLLNSSNQKNYLS (104) | WASTRES (105) | QNDYSFPYT (109) |
| 15 | KSSQSLLNSGNQKNYLS (101) | WASTRES (105) | QNDYSYPYT (107) |
| 16 | KSSQSLLNSGNQKNYLT (102) | WASTRES (105) | QNDYSYPYT (107) |
| 18 | KSSQSLLNSSNQKNYLT (103) | WASTRES (105) | QNDYSYPYT (107) |
| 20 | KSSQSLLNSGNQKNYLT (102) | WASTRES (105) | QNDYSYPYT (107) |
| 21 | KSSQSLLNSGNQKNYLT (102) | WASTRES (105) | QNDYSYPYT (107) |
| 25 | KSSQSLLNSGNQKNYLT (102) | WASTRES (105) | QNDYSFPYT (109) |
| 29 | KSSQSLLNSSNQKNYLS (104) | WASTRES (105) | QNDYSYPYT (107) |
| 31 | KSSQSLLNSSNQKNYLT (103) | WASTRES (105) | QNDYSYPYT (107) |
| 33 | KSSQSLLNSGNQKNYLS (101) | WASTRES (105) | QNEYSYPYT (106) |
| 34 | KSSQSLLNSSNQKNYLT (103) | WASTRES (105) | QNDYSYPYT (107) |
| 35 | KSSQSLLNSGNQKNYLT (102) | WASTRES (105) | QNDYSYPYT (107) |
| 36 | KSSQSLLNSSNQKNYLT (103) | WASTRES (105) | QNDYSFPYT (109) |
| 37 | KSSQSLLNSGNQKNYLT (102) | WASTRES (105) | QNEYSYPYT (106) |
| 38 | KSSQSLLNSGNQKNYLT (102) | WASTRES (105) | QNDYSYPYT (107) |
| 39 | KSSQSLLNSSNQKNYLT (103) | WASTRES (105) | QNEYSFPYT (108) |
| 42 | KSSQSLLNSGNQKNYLS (101) | WASTRES (105) | QNDYSYPYT (107) |
| 43 | KSSQSLLNSGNQKNYLT (102) | WASTRES (105) | QNDYSYPYT (107) |
| 45 | KSSQSLLNSGNQKNYLS (101) | WASTRES (105) | QNDYSFPYT (109) |
| 46 | KSSQSLLNSGNQKNYLS (101) | WASTRES (105) | QNDYSYPYT (107) |
| 47 | KSSQSLLNSGNQKNYLS (101) | WASTRES (105) | QNDYSFPYT (109) |
| 49 | KSSQSLLNSGNQKNYLT (102) | WASTRES (105) | QNDYSFPYT (109) |
| 50 | KSSQSLLNSSNQKNYLT (103) | WASTRES (105) | QNDYSYPYT (107) |
| 52 | KSSQSLLNSGNQKNYLT (102) | WASTRES (105) | QNDYSFPYT (109) |
| 54 | KSSQSLLNSSNQKNYLT (103) | WASTRES (105) | QNDYSFPYT (109) |
| 55 | KSSQSLLNSGNQKNYLS (101) | WASTRES (105) | QNDYSFPYT (109) |

TABLE 5-continued

VL CDR Amino Acid Sequences[1]

| Antibody | VL CDR1 (SEQ ID NO:) | VL CDR2 (SEQ ID NO:) | VL CDR3 (SEQ ID NO:) |
|---|---|---|---|
| 58 | KSSQSLLNSGNQKNYLS (101) | WASTRES (105) | QNDYSYPYT (107) |
| 59 | KSSQSLLNSSNQKNYLS (104) | WASTRES (105) | QNDYSYPYT (107) |
| 61 | KSSQSLLNSGNQKNYLS (101) | WASTRES (105) | QNDYSFPYT (109) |
| 68 | KSSQSLLNSGNQKNYLT (102) | WASTRES (105) | QNDYSYPYT (107) |
| 70 | KSSQSLLNSGNQKNYLS (101) | WASTRES (105) | QNDYSFPYT (109) |
| 71 | KSSQSLLNSSNQKNYLT (103) | WASTRES (105) | QNDYSYPYT (107) |
| 75 | KSSQSLLNSGNQKNYLS (101) | WASTRES (105) | QNDYSYPYT (107) |
| 76 | KSSQSLLNSGNQKNYLS (101) | WASTRES (105) | QNDYSFPYT (109) |
| 78 | KSSQSLLNSGNQKNYLT (102) | WASTRES (105) | QNDYSYPYT (107) |
| 79 | KSSQSLLNSGNQKNYLT (102) | WASTRES (105) | QNDYSYPYT (107) |
| 80 | KSSQSLLNSSNQKNYLT (103) | WASTRES (105) | QNDYSFPYT (109) |
| 85 | KSSQSLLNSSNQKNYLS (104) | WASTRES (105) | QNDYSYPYT (107) |
| 86 | KSSQSLLNSGNQKNYLT (102) | WASTRES (105) | QNDYSYPYT (107) |
| 91 | KSSQSLLNSGNQKNYLS (101) | WASTRES (105) | QNEYSFPYT (108) |
| 92 | KSSQSLLNSGNQKNYLT (102) | WASTRES (105) | QNDYSYPYT (107) |
| 94 | KSSQSLLNSGNQKNYLT (102) | WASTRES (105) | QNDYSYPYT (107) |
| 95 | KSSQSLLNSGNQKNYLT (102) | WASTRES (105) | QNDYSFPYT (109) |
| 96 | KSSQSLLNSSNQKNYLS (104) | WASTRES (105) | QNDYSYPYT (107) |
| 97 | KSSQSLLNSGNQKNYLT (102) | WASTRES (105) | QNEYSFPYT (108) |
| 101 | KSSQSLLNSSNQKNYLT (103) | WASTRES (105) | QNDYSFPYT (109) |
| 102 | KSSQSLLNSSNQKNYLS (104) | WASTRES (105) | QNDYSYPYT (107) |
| 105 | KSSQSLLNSGNQKNYLS (101) | WASTRES (105) | QNDYSYPYT (107) |
| 107 | KSSQSLLNSGNQKNYLS (101) | WASTRES (105) | QNDYSYPYT (107) |

[1]The VL CDRs in Table 5 are determined according to Kabat.

TABLE 6

VH CDR Amino Acid Sequences[2]

| Antibody | VH CDR1 (SEQ ID NO:) | VH CDR2 (SEQ ID NO:) | VH CDR3 (SEQ ID NO:) |
|---|---|---|---|
| 231-32-15 | DYAMY (13) | VIRTYSGDVTYNQKFKD (14) | SGTVRGFAY (15) |
| Hum231#1 | DYAMY (13) | VIRTYSGDVTYNQKFKD (14) | SGTVRGFAY (15) |
| Hum231#2 | DYAMY (13) | VIRTYSGDVTYNQKFKD (14) | SGTVRGFAY (15) |
| pab1964 | GYAMY (19) | LIRTYSGGVTYNQKFQG (24) | SGTVRGFAY (34) |
| pab1965 | GYAMY (19) | VIRTFSGDVTYNQKFRG (25) | SGTVRGFAY (34) |
| pab1966 | GYAMY (19) | VIKTYSGGVTYNQKFRG (26) | SGTVRGFAY (34) |
| pab1967 | GYAMH (20) | LIRTYSGGVSYNQKFRE (27) | SGTVRGFAY (34) |
| pab1968 | DYAMY (21) | VIRTFSGDLTYNQKFQD (28) | SGTVRGFAY (34) |
| pab1969 | EYAMH (22) | LIRTYSGGVSYNQKFQG (29) | SGTVRGFAY (34) |

TABLE 6-continued

VH CDR Amino Acid Sequences[2]

| Antibody | VH CDR1 (SEQ ID NO:) | VH CDR2 (SEQ ID NO:) | VH CDR3 (SEQ ID NO:) |
|---|---|---|---|
| pab1970 | DYAMY (21) | LIRTYSGGVTYNQKFQG (24) | SGTVRGFAY (34) |
| pab1971 | DYAMY (21) | VIRTYSGDVSYNQKFRG (177) | SGTVRGFAY (34) |
| pab1972 | EYAMY (23) | LIRTYSGGVSYNQKFRD (31) | SGTVRGFAY (34) |
| pab1973 | GYAMY (19) | VIRTFSGGVTYNQKFRG (32) | SGTVRGFAY (34) |
| pab1975 | EYAMH (22) | LIRTYSGGVSYNQKFQG (29) | SGTVRGFAY (34) |
| pab1976 | EYAMH (22) | LIRTYSGGVSYNQKFQG (29) | SGTVRGFAY (34) |
| pab1977 | EYAMH (22) | LIRTYSGGVSYNQKFQG (29) | SGTVRGFAY (34) |
| pab1979 | EYAMH (22) | VIRTYSGGVSYNQKFQE (33) | SGTVRGFAY (34) |
| pab1980 | EYAMH (22) | VIRTYSGGVSYNQKFQE (33) | SGTVRGFAY (34) |
| pab1981 | EYAMH (22) | VIRTYSGGVSYNQKFQE (33) | SGTVRGFAY (34) |
| pab1983 | GYAMY (19) | LIRTYSGGVTYNQKFQG (24) | SGTVRGFAY (34) |
| pab2159 | GYAMY (19) | LIRTYSGEVSYNQKFRG (144) | SGTVRGFAY (34) |
| pab2160 | GYVMH (119) | VIRTFSGDVSYNQKFRE (162) | SGTVRGFAY (34) |
| pab2161 | EYAMH (22) | LIQTYSGDVSYNQKFRG (121) | SGTVRGFAY (34) |
| 1 | EYAMY (23) | VIRTYSGGVTYNQKFQG (187) | SGTVRGFAY (34) |
| 2 | EYAMH (22) | LIRTYSGGVSYNQKFRG (148) | SGTVRGFAY (34) |
| 4 | EYAMY (23) | LIRTFSGDVSYNQKFQD (124) | SGTVRGFAY (34) |
| 5 | EYAMH (22) | LIRTYSGGVTYNQKFRG (151) | SGTVRGFAY (34) |
| 6 | EYAMY (23) | LIRTFSGGVSYNQKFKG (135) | SGTVRGFAY (34) |
| 9 | GYAMY (19) | LIRTYSGEVSYNQKFRG (144) | SGTVRGFAY (34) |
| 10 | EYAMY (23) | LIRTYSGGVSYNQKFRG (148) | SGTVRGFAY (34) |
| 11 | DYAMH (117) | LIRTYSGGVSYNQKFRG (148) | SGTVRGFAY (34) |
| 15 | DYAMY (21) | VIRTFSGDVSYNQKFRE (162) | SGTVRGFAY (34) |
| 16 | GYAMY (19) | LIRTFSGGVTYNQKFRE (140) | SGTVRGFAY (34) |
| 18 | GYAMY (19) | LIRTFSGEVTYNQKFRG (130) | SGTVRGFAY (34) |
| 20 | DYAMY (21) | VIRTFSGDLSYNQKFRG (114) | SGTVRGFAY (34) |
| 21 | GYVMH (119) | VIRTFSGDVSYNQKFRE (162) | SGTVRGFAY (34) |
| 25 | EYAMY (23) | LIRTFSGGVSYNQKFRG (138) | SGTVRGFAY (34) |
| 29 | DYAMY (21) | VIRTFSGGVTYNQKFKG (172) | SGTVRGFAY (34) |
| 31 | EYAMY (23) | LIRTFSGGLTYNQKFKD (133) | SGTVRGFAY (34) |
| 33 | GYAMY (19) | LIRTYSGGVTYNQKFQG (24) | SGTVRGFAY (34) |
| 34 | DYAMY (21) | VIRTFSGGVTYNQKFRG (32) | SGTVRGFAY (34) |
| 35 | GYAMY (19) | VIRTFSGDVTYNQKFRG (25) | SGTVRGFAY (34) |
| 36 | DYAMY (21) | VIRTFSGGVSYNQKFRD (168) | SGTVRGFAY (34) |
| 37 | EYAMY (23) | LIRTFSGEVTYNQKFKD (129) | SGTVRGFAY (34) |
| 38 | GYAMY (19) | VIKTYSGGVTYNQKFRG (26) | SGTVRGFAY (34) |
| 39 | GYAMH (20) | LIRTYSGGVSYNQKFRE (27) | SGTVRGFAY (34) |
| 42 | DYAMY (21) | VIRTFSGDLTYNQKFQD (28) | SGTVRGFAY (34) |

TABLE 6-continued

| Antibody | VH CDR1 (SEQ ID NO:) | VH CDR2 (SEQ ID NO:) | VH CDR3 (SEQ ID NO:) |
|---|---|---|---|
| 43 | EYAMY (23) | LIRTFSGDVSYNQKFKG (123) | SGTVRGFAY (34) |
| 45 | EYAMY (23) | LIRTYSGGVSYNQKFQG (147) | SGTVRGFAY (34) |
| 46 | EYAMY (23) | LIRTFSGDLSYNQKFRG (122) | SGTVRGFAY (34) |
| 47 | DYAMY (21) | VIRTYSGGVTYNQKFRD (188) | SGTVRGFAD (189) |
| 49 | GYAMY (19) | VIRTYSGDVTYNQKFRE (179) | SGTVRGFAY (34) |
| 50 | DYAMY (21) | LIRTFSGGVSYNQKFKE (134) | SGTVRGFAY (34) |
| 52 | DYAMY (21) | LIRTYSGGVSYNQKFRE (27) | SGTVRGFAY (34) |
| 54 | EYAMH (22) | LIRTYSGGVSYNQKFQG (147) | SGTVRGFAY (34) |
| 55 | DYAMY (21) | LIRTYSGGVTYNQKFQG (24) | SGTVRGFAY (34) |
| 58 | DYAMY (21) | VIRTYSGGVTYNQKFKG (186) | SGTVRGFAY (34) |
| 59 | EYAMY (23) | LIRTYSGGVSYNQKFRD (31) | SGTVRGFAY (34) |
| 61 | EYAMH (22) | LIRTYSGGVSYNQKFQE (115) | SGTVRGFAY (34) |
| 68 | GYAMY (19) | LIRTYSGGVTYNQKFRG (151) | SGTVRGFAY (34) |
| 70 | GYAMY (19) | VIRTYSGDVTYNQKFKD (178) | SGTVRGFAY (34) |
| 71 | GYAMY (19) | VIRTFSGGVTYNQKFRG (32) | SGTVRGFAY (34) |
| 75 | GYAMY (19) | VIRTYSGGVTYNQKFQG (187) | SGTVRGFAY (34) |
| 76 | DYAMH (117) | LIRTFSGDVSYNQKFRE (125) | SGTVRGFAY (34) |
| 78 | DYAMY (21) | VIKTYSGGVTYNQKFRD (155) | SGTVRGFAY (34) |
| 79 | EYAMH (22) | LIRTYSGGVTYNQKFRE (150) | SGTVRGFAY (34) |
| 80 | EYAMH (22) | LIRTFSGDVSYNQKFRG (126) | SGTVRGFAY (34) |
| 85 | EYAMY (23) | VIRTYSGGVTYNQKFKD (185) | SGTVRGFAY (34) |
| 86 | EYAMY (23) | VIRTYSGGVTYNQKFRD (188) | SGTVRGFAY (34) |
| 91 | EYAMH (22) | LIRTYSGGVSYNQKFQE (115) | SGTVRGFAY (34) |
| 92 | EYAMY (23) | LIRTFSGGVTYNQKFQG (139) | SGTVRGFAY (34) |
| 94 | GYAMY (19) | VIRTFSGGVTYNQKFRD (173) | SGTVRGFAY (34) |
| 95 | DYAMY (21) | LIRTYSGGVSYNQKFRG (148) | SGTVRGFAY (34) |
| 96 | EYAMY (23) | VIRTYSGGLTYNQKFRD (184) | SGTVRGFAY (34) |
| 97 | EYAMH (22) | LIRTFSGGLSYNQKFRD (131) | SGTVRGFAY (34) |
| 101 | DYAMH (117) | LIRTFSGGVSYNQKFQD (136) | SGTVRGFAY (34) |
| 102 | GYAMY (19) | VIRTYSGGVSYNQKFRD (194) | SGTVRGFAY (34) |
| 105 | EYAMY (23) | LIRTFSGGVSYNQKFKG (135) | SGTVRGFAY (34) |
| 107 | GYAMY (19) | VIRTYSGDVSYNQKFRD (176) | SGTVRGFAY (34) |

[2]The VH CDRs in Table 6 were determined according to Kabat.

TABLE 7

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 231-32-15 | DIVMTQSPSSLTVTAG EKVIMSC (616) | WYQQKPGQPPK LLIY (623) | GVPDRFTGSGSGTDFTLTISS VQAEDLAVYHC (637) | FGGGTKLEIK (641) |
| Hum231 #1 | DIVMTQSPPTLSLSPG ERVTLSC (615) | WYQQKPGQAPR LLIY (622) | GIPARFSGSGSGTDFTLTISS LQPEDFAVYHC (626) | FGQGTKLEIK (643) |
| Hum231 #2 | DIVMTQSPDSLAVSLG ERATINC (611) | WYQQKPGQPPK LLIY (623) | GVPDRFSGSGSGTDFTLTISS LQAEDVAVYHC (630) | FGQGTKLEIK (643) |
| pab1964 | DIVMTQSPDSLAVSLG ERATINC (611) | WYHQKPGQPPK LLIY (618) | GVPDRFSGSGSGTDFTLTISS VQAEDVAVYHC (632) | FGQGTKLEIK (643) |
| pab1965 | DIVMTQSPDSLAVSLG ERATINC (611) | WYHQKPGQPPK LLIY (618) | GVPDRFTGSGSGTDFTLTISS VQAEDVAVYYC (639) | FGQGTKLEIK (643) |
| pab1966 | DIVMTQSPDSLAVSLG ERATINC (611) | WYQQKPGQPPK LLIY (623) | GVPDRFSGSGSGTDFTLTISS LQAEDVAVYYC (631) | FGQGTKLEIK (643) |
| pab1967 | DIVMTQSPDSLAVSLG ERATINC (611) | WYQQKPGQPPK LLIY (623) | GVPDRFTGSGSGTDFTLTISS VQAEDVAVYHC (638) | FGQGTKLEIK (643) |
| pab1968 | DIVMTQSPDSLAVSLG ERATINC (611) | WYQQKPGQPPK LLIY (623) | GVPDRFSGSGSGTDFTLTISS LQAEDVAVYYC (631) | FGQGTKLEIK (643) |
| pab1969 | DIVMTQSPDSLAVSLG ERATINC (611) | WYQQKPGQPPK LLIY (623) | GVPDRFTGSGSGTDFTLTISS VQAEDVAVYHC (638) | FGQGTKLEIK (643) |
| pab1970 | DIVMTQSPDSLAVSLG ERATINC (611) | WYQQKPGQPPK LLIY (623) | GVPDRFSGSGSGTDFTLTISS VQAEDVAVYHC (632) | FGQGTKLEIK (643) |
| pab1971 | DIVMTQSPDSLAVSLG ERATINC (611) | WYQQKPGQPPK LLIY (623) | GVPDRFTGSGSGTDFTLTISS LQAEDVAVYYC (642) | FGQGTKLEIK (643) |
| pab1972 | DIVMTQSPDSLAVSLG ERATINC (611) | WYHQKPGQPPK LLIY (618) | GVPDRFSGSGSGTDFTLTISS VQAEDVAVYHC (632) | FGQGTKLEIK (643) |
| pab1973 | DIVMTQSPDSLAVSLG ERATINC (611) | WYQQKPGQPPK LLIY (623) | GVPDRFTGSGSGSDTDFTLTISS VQAEDVAVYHC (627) | FGQGTKLEIK (643) |
| pab1975 | DIVMTQSPDSLAVSLG ERATINC (611) | WYQQKPGQPPK LLIY (623) | GVPDRFSGSGSGTDFTLTISS LQAEDVAVYYC (631) | FGQGTKLEIK (643) |
| pab1976 | DIVMTQSPDSLAVSLG ERATINC (611) | WYQQKPGQPPK LLIY (623) | GVPDRFSGSGSGTDFTLTISS LQAEDVAVYYC (631) | FGQGTKLEIK (643) |
| pab1977 | DIVMTQSPDSLAVSLG ERATINC (611) | WYQQKPGQPPK LLIY (623) | GVPDRFTGSGSGTDFTLTISS LQAEDVAVYYC (642) | FGQGTKLEIK (643) |
| pab1979 | DIVMTQSPDSLAVSLG ERATINC (611) | WYQQKPGQPPK LLIY (623) | GVPDRFSGSGSGTDFTLTISS LQAEDVAVYYC (631) | FGQGTKLEIK (643) |
| pab1980 | DIVMTQSPDSLAVSLG ERATINC (611) | WYQQKPGQPPK LLIY (623) | GVPDRFSGSGSGTDFTLTISS LQAEDVAVYYC (631) | FGQGTKLEIK (643) |
| pab1981 | DIVMTQSPDSLAVSLG ERATINC (611) | WYQQKPGQPPK LLIY (623) | GVPDRFTGSGSGTDFTLTISS LQAEDVAVYYC (642) | FGQGTKLEIK (643) |
| pab1983 | DIVMTQSPDSLAVSLG ERATINC (611) | WYQQKPGQPPK LLIY (623) | GVPDRFSGSGSGTDFTLTISS LQAEDVAVYYC (631) | FGQGTKLEIK (643) |
| pab2159 | DIVMTQSPDSLAVSLG ERATINC (611) | WYQQKPGQPPK MLIY (624) | GVPDRFSGSGSGTDFTLTISS LQAEDVAVYHC (630) | FGQGTKLEIK (643) |
| pab2160 | DIVMTQSPDSLAVSLG ERATINC (611) | WYHQKPGQPPK LLIY (618) | GVPDRFSGSGSGTDFTLTISS VQAEDVAVYHC (632) | FGQGTKLEIK (643) |
| pab2161 | DIVMTQSPDSLAVSLG ERATINC (611) | WYHQKPGQPPK LLIY (618) | GVPDRFTGSGSGTDFTLTISS VQAEDVAVYYC (639) | FGQGTKLEIK (643) |
| 1 | DIVMTQSPDSLAVSLG ERATINC (611) | WYHQKPGQPPK MLIY (619) | GVPDRFSGSGSGTDFTLTISS VQAEDVAVYHC (632) | FGQGTKLEIK (643) |
| 2 | DIVMTQSPDSLAVSLG ERATINC (611) | WYHQKPGQPPK LLIY (618) | GVPDRFSGSGSGTDFTLTISS VQAEDVAVYYC (633) | FGQGTKLEIK (643) |

TABLE 7-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 4 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 5 | DIVMTQSPDSLAAPGERATINC (610) | WYHQKPGQPPKLLIY (618) | GVPDRFTGSGSGTDFTLTISSVQAEDVAVYYC (639) | FGQGTKLEIK (643) |
| 6 | DIVMTQSPDSLAVSLGERATINC (611) | WYQQKPGQPPKMLIY (624) | GVPDRFTGSGSGTDFTLTISSLQAEDVAVYHC (636) | FGQGTKLEIK (643) |
| 9 | DIVMTQSPDSLAVSLGERATINC (611) | WYQQKPGQPPKMLIY (624) | GVPDRFSGSGSGTDFTLTISSLQAEDVAVYHC (630) | FGQGTKLEIK (643) |
| 10 | DIVMTQSPDSLAVSLGERATINC (611) | WYQQKPGQPPKLLIY (623) | GVPDRFSGSGSGTDFTLTISSVQAEDVAVYHC (632) | FGQGTKLEIK (643) |
| 11 | DIVMTQSPDSLAVSLGERATINC (611) | WYQQKPGQPPKLLIY (623) | GVPDRFSGSGSGTDFTLTISSVQAEDVAVYHC (632) | FGQGTKLEIK (643) |
| 15 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 16 | DIVMTQSPDSLAVSLGERATINC (611) | WYHQKPGQPPKLLIY (618) | GVPDRFTGSGSGTDFTLTISSVQAEDVAVYHC (638) | FGQGTKLEIK (643) |
| 18 | DIVMTQSPDSLAVSLGERATINC (611) | WYHQKPGQPPKMLIY (619) | GVPDRFTGSGSGTDFTLTISSVQAEDVAVYYC (639) | FGQGTKLEIK (643) |
| 20 | DIVMTQSPDSLAVSLGERATINC (611) | WYHQKPGQPPKMLLY (624) | GVPDRFTGSGSGTDFTLTISSVQAEDVAVYHC (620) | FGQGTKLEIK (643) |
| 21 | DIVMTQSPDSLAVSLGERATINC (611) | WYQQKPGQPPKLLIY (618) | GVPDRFSGSGSGTDFTLTISSVQAEDVAVYHC (632) | FGQGTKLEIK (643) |
| 25 | DIVMTQSPDSLAVSLGERATINC (611) | WYQQKPGQPPKMLIY (624) | GVPDRFTGSGSGTDFTLTISSVQAEDVAVYYC (639) | FGQGTKLEIK (643) |
| 29 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |
| 31 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 33 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 34 | DIVMTQSTDSLAVSLGERATINC (617) | WYQQKPGQPPKLLIY (623) | GVPDRFTGSGSGTDFTLTISSLQAEDVAVYHC (636) | FGQGTKLEIK (643) |
| 35 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 36 | DIVMTQSPDSLAVSLGERATINC (611) | WYHQKPGQPPKMLIY (619) | GVPDRFSGSGSGTDFTLTISSVQEEDVAVYHC (634) | FGQGTKLEIK (643) |
| 37 | DIVMTQSPDSLAVSLGERATINC (611) | WYQQKPGQPPKLLIY (623) | GVPDRFTGSGSGTDFTLTISSLQAEDVAVYHC (636) | FGQGTKLEIK (643) |
| 38 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| 39 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 42 | DIVMTQSPDSLAVSLGERATINC (611) | WYQQKPGQPPKLLIY (623) | GVPDRFSGSGSGTDFTLTISSLQAEDVAVYYC (631) | FGQGTKLEIK (643) |
| 43 | DIVMTQSPDSLAVSLGERATINC (611) | WYQQKPGQPPKMLIY (624) | GVPDRFTGSGSGTDFTLTISSVQAEDVAVYHC (638) | FGQGTKLEIK (643) |
| 45 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |
| 46 | DIVMTQSPDSLAVSLGERATINC (611) | WYHQKPGQPPKLLIY (618) | GVPDRFTGSGSGTDFTLTISSLQAEDVAVYHC (636) | FGQGTKLEIK (643) |

TABLE 7-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 47 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 49 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 50 | DIVMTQSPDSLAVSLGERATINC (611) | WYQQKPGQPPKMLIY (624) | GVPDRFSGSGSGTDFTLTISSLQAEDVAVYYC (631) | FGQGTKLEIK (643) |
| 52 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |
| 54 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 55 | DIVMTQSPDSLAVSLGERATINC (611) | WYQQKPGQPPKLLIY (623) | GVPDRFSGSGSGTDFTLTISSVQAEDVAVYHC (632) | FGQGTKLEIK (643) |
| 58 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 59 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 61 | DIVMTQSPDSLAVSLGERATINC (611) | WYQQKPGQPPKLLIY (623) | GVPDRFSGSGSGTDFTLTISSVQAEDVAVYYC (633) | FGQGTKLEIK (643) |
| 68 | DIVMTQSPDSLAVSLGERATINC (611) | WYQQKPGQPPKMLIY (624) | GVPDRFSGSGSGTDFTLTISSLQAEDVAVYYC (642) | FGQGTKLEIK (643) |
| 70 | DIVMTQSPDSLAVSLGERATINC (611) | WYQQKPGQPPKLLIY (623) | GVPDRFSGSGSGTDFTLTISSLQAEDVAVYHC (630) | FGQGTKLEIK (643) |
| 71 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 75 | DIVMTQSPDSLAVSLGERATINC (611) | WYHQKPGQPPKLLIY (618) | GVPDRFTGSGSGTDFTLTISSLQAEDVAVYYC (642) | FGQGTKLEIK (643) |
| 76 | DIVMTQSPDSLAVSLGERATINC (611) | WYQQKPGQPPKMLIY (624) | GVPDRFSGSGSGTDFTLTISSVQAEDVAVYHC (632) | FGQGTKLEIK (643) |
| 78 | DIVMTQSPDSLAVSLGERATINC (611) | WYHQKPGQPPKMLIY (619) | GVPDRFTGSGSGTDFTLTISSVQAEDVAVYHC (638) | FGQGTKLEIK (643) |
| 79 | DIVMTQSPDSLAVSLGERATINC (611) | WYHQKPGQPPKMLIY (619) | GVPDRFSGSGSGTDFTLTISSLQAEDVAVYYC (631) | FGQGTKLEIK (643) |
| 80 | DIVMTQSPDSLAVSLGERATINC (611) | WYQQKPGQPPKLLIY (623) | GVPDRFTGSGSGTDFTLTISSLQAEDVAVYYC (642) | FGQGTKLEIK (643) |
| 85 | DIVMTQSPDSLAVSLGERATINC (611) | WYHQKPGQPPKLLIY (618) | GVPDRFSGSGSGTDFTLTISSVQAEDVAVYYC (633) | FGQGTKLEIK (643) |
| 86 | DIVMTQSPDSLAVSLGERATINC (611) | WYHQKPGQPPKLLIY (618) | GVPDRFSGSGSGTDFTLTISSVQAEDVAVYYC (633) | FGQGTKLEIK (643) |
| 91 | DIVMTQSPDSLAVSLGERATINC (611) | WYQQKPGQPPKLLIY (623) | GVPDRFSGSGSGTDFTLTISSVQAEDVAVYHC (632) | FGQGTKLEIK (643) |
| 92 | DIVMTQSPDSLAVSLGERATINC (611) | WYHQKPGQPPKMLIY (619) | GVPDRFSGSGSGTNFTLTISSVQAEDVAVYHC (635) | FGQGTKLEIK (643) |
| 94 | DIVMTQSPDSLAVSLGERATINC (611) | WYQQKPGQPPKLLIY (623) | GVPDRFTGSGSGTDFTLTISSVQAEDVAVYHC (638) | FGQGTKLEIK (643) |
| 95 | DIVMTQSPDSLAVSLGERATINC (611) | WYQQKPGQPPKMLIY (624) | GVPDRFSGSGSGTDFTLTISSVQAEDVAVYHC (632) | FGQGTKLEIK (643) |
| 96 | DIVMTQSPDSLAVSLGERATINC (611) | WYHQKPGQPPKLLIY (618) | GVPDRFSGSGSGTDFTLTISSLQAEDVAVYHC (630) | FGQGTKLEIK (643) |
| 97 | DIVMTQSPDSLAVSLGERATINC (611) | WYHQKPGQPPKLLIY (618) | GVPDRFTGSGSGTDFTLTISSVQAEDVAVYHC (638) | FGQGTKLEIK (643) |

TABLE 7-continued

VL FR Amino Acid Sequences[3]

| Antibody | VL FR1 (SEQ ID NO:) | VL FR2 (SEQ ID NO:) | VL FR3 (SEQ ID NO:) | VL FR4 (SEQ ID NO:) |
|---|---|---|---|---|
| 101 | DIVMTQSPDSLAVSLGERATINC (611) | WYHQKPGQPPKLLIY (618) | GVPDRFSGSGSGTDFTLTISSVQAEDVAVYHC (632) | FGQGTKLEIK (643) |
| 102 | DIVMTQSPDSLAVSLGERATINC (611) | WYQQKPGQPPKLLIY (623) | GVPDRFTGSGSGTDFTLTISSVQAEDVAVYYC (639) | FGQGTKLEIK (643) |
| 105 | DIVMTQSPDSLAVSLGERATINC (611) | WYQQKPGQPPKLLIY (623) | GVPDRFSGSGSGTDFTLTISSVQAEDVAVYYC (633) | FGQGTKLEIK (643) |
| 107 | DIVMTQSPDSLAVSLGERATINC (611) | WYHQKPGQPPKLLIY (618) | GVPDRFTGSGSGTDFTLTISSVQAEDVAVYYC (639) | FGQGTKLEIK (643) |

[3]The VL framework regions described in Table 7 are determined based upon the boundaries of the Kabat numbering system for CDRs. In other words, the VL CDRs are determined by Kabat and the framework regions are the amino acid residues surrounding the CDRs in the variable region in the format FR1, CDR1, FR2, CDR2, FR3, CDR3, and FR4.

TABLE 8

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 231-32-15 | QVQLLSGTELVRPGVSVKISCKGSGYTFT (645) | WVKQSHAKSLEWIG (652) | KATMTVDKSSSIAYMELARLSSEDSAIYYCAK (658) | WGQGTLVTVSS (668) |
| Hum231#1 | QVQLVQSGAEVKKPGASVKVSCKGSGYTFT (649) | WVRQAPGQGLEWIG (653) | RATMTVDKSISTAYMELSRLRSDDTAVYYCAK (659) | WGQGTLVTVSS (668) |
| Hum231#2 | QVQLVQSGAEVKKPGASVKVSCKGSGYTFT (649) | WVRQAPGQGLEWIG (653) | RATMTVDKSISTAYMELSRLRSDDTAVYYCAK (659) | WGQGTLVTVSS (668) |
| pab1964 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| pab1965 | QVQLVQSGAEAKKPGASVKVSCKGSGYTFT (646) | WVRQAPGQGMEWIG (655) | RVTMTVDTSISTAYMELSRLRSDDTAVYYCAK (663) | WGQGTLVTVSS (668) |
| pab1966 | QVQLVQSGTEVKKPGASVKVSCKGSGYTFT (651) | WVRQAPGQGLEWIG (653) | RVTMTVDKSISTAYMELSRLRSDDTAVYYCAK (662) | WGQGTLVTVSS (668) |
| pab1967 | QVQLVQSGAEVKKPGASVKVSCKGSGYTFT (649) | WVRQAPGQGLEWMG (654) | RATMTVDTSISTAYMELSRLRSDDTAVYYCAK (670) | WGQGTLVTVSS (667) |
| pab1968 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| pab1969 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1970 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| pab1971 | QVQLVQSGTEVKKPGASVKVSCKGSGYTFT (651) | WVRQAPGQGMEWMG (656) | RVTMTVDTSISTAYMELSRLRSDDTAVYYCAK (663) | WGQGTLVTVSS (668) |
| pab1972 | QVQLVQSGAEVKKPGASVKVSCKASGYTFT (648) | WVRQAPGQGLEWMG (654) | RVTMTVDKSISTAYMELSRLRSDDTAVYYCAK (662) | WGQGTLVTVSS (668) |
| pab1973 | QVQLVQSGAEVKKPGASVKVSCKASGYTFT (648) | WVRQAPGQGMEWMG (656) | RATMTVDTSISTAYMELSRLRSDDTAVYYCAK (670) | WGQGTLVTVSS (668) |
| pab1975 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1976 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1977 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| pab1979 | QVQLVQSGAEVKKPGASVKVSCKASGYTFT (648) | WVRQAPGQGLEWMG (654) | RVTMTVDTSISTAYMELSRLRSDDTAVYYCAK (663) | WGQGTLVTVSS (668) |

TABLE 8-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| pab1980 | QVQLVQSGAEVKKPGASVKVSCKASGYTFT (648) | WVRQAPGQGLEWMG (654) | RVTMTVDTSISTAYMELSRLRSDDTAVYYCAK (663) | WGQGTLVTVSS (668) |
| pab1981 | QVQLVQSGAEVKKPGASVKVSCKASGYTFT (648) | WVRQAPGQGLEWMG (654) | RVTMTVDTSISTAYMELSRLRSDDTAVYYCAK (663) | WGQGTLVTVSS (668) |
| pab1983 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| pab2159 | QVQLVQSGAEVKKPGASVKVSCKASGYTFT (648) | WVRQAPGQGLEWMG (654) | RATMTVDKSISTAYMELSRLRSDDTAVYYCAK (659) | WGQGTLVTVSS (668) |
| pab2160 | QVQLVQSGTEVKKPGASVKVSCKGSGYTFT (651) | WVRQAPGQGMEWIG (655) | RVTMTVDTSISTAYMELSRLRSDDTAVYYCAK (663) | WGQGTLVTVSS (668) |
| pab2161 | QVQLVQSGAEVKKPGASVKVSCKGSGYTFT (649) | WVRQAPGQGLEWIG (653) | RATMTVDTSISTAYMELSRLRSDDTAVYYCAK (670) | WGQGTLVTVSS (668) |
| 1 | QVQLVQSGTEVKKPGASVKVSCKGSGYTFT (651) | WVRQAPGQGLEWIG (653) | RATMTVDTSISTAYMELSRLRSDDTAVYYCAK (670) | WGQGTLVTVSS (668) |
| 2 | QVQLVQSGAEVKKPGASVKVSCKASGYTFT (648) | WVRQAPGQGMEWIG (655) | RATMTVDKSISTAYMELSRLRSDDTAVYYCAK (659) | WGQGTLVTVSS (668) |
| 4 | QVQLVQSGAEVKKPGASVKVSCKASGYTFT (648) | WVRQAPGQSLEWMG (657) | RVTMTVDKSISTAYMELSRLRSDDTAVYYCAK (662) | WGQGTLVTVSS (668) |
| 5 | QVQLVQSGAEVKKPGASVKVSCKGSGYTFT (649) | WVRQAPGQGLEWMG (654) | RVTMTVDTSISTAYMELSRLRSDDTAVYYCAK (663) | WGQGTLVTVSS (668) |
| 6 | QVQLVQSGAEVKKPGASVKVSCKGSGYTFT (649) | WVRQAPGQGLEWMG (654) | RATMTVDTSISTAYMELSRLRSDDTAVYYCAK (670) | WGQGTLVTVSS (668) |
| 9 | QVQLVQSGAEVKKPGASVKVSCKASGYTFT (648) | WVRQAPGQGLEWMG (654) | RATMTVDKSISTAYMELSRLRSDDTAVYYCAK (659) | WGQGTLVTVSS (668) |
| 10 | QVQLVQSGAEVKKPGASVKVSCKASGYTFT (648) | WVRQAPGQGLEWMG (654) | RVTMTVDKSISTAYMELSRLRSDDTAVYYCAK (662) | WGQGTLVTVSS (668) |
| 11 | QVQLVQSGAEVKKPGASVKVSCKGSGYTFT (649) | WVRQAPGQGLEWMG (654) | RVTMTVDTSISTAYMELSRLRSDDTAVYYCAK (663) | WGQGTLVTVSS (668) |
| 15 | QVQLVQSGAEVKKPGASVKVSCKGSGYTFT (649) | WVRQAPGQGLEWIG (653) | RATMTVDKSISTAYMELSRLRSDDTAVYYCAK (659) | WGQGTLVTVSS (668) |
| 16 | QVQLVQSGTEVKKPGASVKVSCKASGYTFT (650) | WVRQAPGQGLEWIG (653) | RVTMTVDKSISTAYMELSRLRSDDTAVYYCAK (662) | WGQGTLVTVSS (668) |
| 18 | QVQLVQSGTEVKKPGASVKVSCKASGYTFT (650) | WVRQAPGQGMEWIG (655) | RVTMTVDTSISTAYMELSRLRSDDTAVYYCAK (663) | WGQGTLVTVSS (668) |
| 20 | QVQLVQSGTEVKKPGASVKVSCKASGYTFT (650) | WVRQAPGQGLEWIG (653) | RVTMTVDTSISTAYMELSRLRSDDTAVYYCAK (663) | WGQGTLVTVSS (668) |
| 21 | QVQLVQSGTEVKKPGASVKVSCKGSGYTFT (651) | WVRQAPGQGMEWIG (655) | RVTMTVDTSISTAYMELSRLRSDDTAVYYCAK (663) | WGQGTLVTVSS (668) |
| 25 | QVQLVQSGAEVKKPGASVKVSCKASGYTFT (648) | WVRQAPGQGLEWMG (654) | RATMTVDTSISTAYMELSRLRSDDTAVYYCAK (670) | WGQGTLVTVSS (668) |
| 29 | QVQLVQSGAEVKKPGASVKVSCKGSGYTFT (649) | WVRQAPGQGLEWIG (653) | RATMTVDTSISTAYMELSRLRSDDTAVYYCAK (670) | WGQGTLVTVSS (668) |
| 31 | QVQLVQSGTEVKKPGASVKVSCKGSGYTFT (651) | WVRQAPGQGLEWMG (654) | RVTMTVDKSISTAYMELSRLRSDDTAVYYCAK (662) | WGQGIPVTVSS (664) |
| 33 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| 34 | QVQLVQSGAEVKKPGASVKVSCKASGYTFT (648) | WVRQAPGQGMEWIG (655) | RVTMTVDTSISTAYMELSRLRSDDTAVYYCAK (663) | WGQGTLVTVSS (668) |
| 35 | QVQLVQSGAEAKKPGASVKVSCKGSGYTFT (646) | WVRQAPGQGMEWIG (655) | RVTMTVDTSISTAYMELSRLRSDDTAVYYCAK (663) | WGQGTLVTVSS (668) |

TABLE 8-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 36 | QVQLVQSGAEVKKPGASVKV SCKGSGYTFT (649) | WVRQAPGQGMEWI G (655) | RVTMTVDKSISTAYMELSRLR SDDTAVYYCAK (662) | WGQGTLVTVSS (668) |
| 37 | QVQLVQSGTEVKKPGASVKV SCKGSGYTFT (651) | WVRQAPGQGMEWI G (655) | RVTMTVDTSISTAYMELSRLR SDDTAVYYCAK (663) | WGQGTLVTVSS (668) |
| 38 | QVQLVQSGTEVKKPGASVKV SCKGSGYTFT (651) | WVRQAPGQGLEWI G (653) | RVTMTVDKSISTAYMELSRLR SDDTAVYYCAK (662) | WGQGTLVTVSS (668) |
| 39 | QVQLVQSGAEVKKPGASVKV SCKGSGYTFT (649) | WVRQAPGQGLEWM G (654) | RATMTVDTSISTAYMELSRLR SDDTAVYYCAK (670) | WGQGTLVTVSS (667) |
| 42 | QVQLVQSGTEVKKPGASVKV SCKASGYTFT (650) | WVRQAPGQGLEWI G (653) | RVTMTVDTSISTAYMELSRLR SDDTAVYYCAK (663) | WGQGTLVTVSS (668) |
| 43 | QVQLVQSGAEVKKPGASVKV SCKGSGYTFT (649) | WVRQAPGQGMEWI G (655) | RATMTVDKSISTAYMELSRLR SDDTAVYYCAK (659) | WGQGTLVTVSS (668) |
| 45 | QVQLVQSGAEVKKPGASVKV SCKGSGYTFT (649) | WVRQAPGQGLEWI G (653) | RVTMTVDTSISTAYMELSRLR SDDTAVYYCAK (663) | WGQGTFVTVSS (665) |
| 46 | QVQLVQSGAEVKKPGASVKV SCKASGYTFT (648) | WVRQAPGQGLEWM G (654) | RVTMTVDTSISTAYMELSRLR SDDTAVYYCAK (663) | WGQGTLVTVSS (668) |
| 47 | QVQLVQSGAEVKKPGASVKV SCKASGYTFT (648) | WVRQAPGQGLEWM G (656) | RVTMTVDKSISTAYMELSRLR SDDTAVYYCAK (662) | WGQGTLVTVSS (668) |
| 49 | QVQLVQSGTEVKKPGASVKV SCKGSGYTFT (651) | WVRQAPGQGLEWM G (654) | RATMTVDTSISTAYMELSRLR SDDTAVYYCAK (670) | WGQGTLVTVSS (668) |
| 50 | QVQLVQSGTEVKKPGASVKV SCKASGYTFT (650) | WVRQAPGQGLEWI G (653) | RVTMTVDKSISTAYMELSRLR SDDTAVYYCAK (662) | WGQGTLVTVSS (668) |
| 52 | QVQLVQSGTEVKKPGASVKV SCKGSGYTFT (651) | WVRQAPGQGLEWM G (654) | RVTMTVDKSISTAYMELSRLR SDDTAVYYCAK (662) | WGQGTLVTVSS (668) |
| 54 | QVQLVQSGAEVKKPGASVKV SCKASGYTFT (648) | WVRQAPGQGLEWM G (654) | RATMTVDKSISTAYMELSRLR SDDTAVYYCAK (670) | WGQGTLVTVSS (668) |
| 55 | QVQLVQSGTEVKKPGASVKV SCKASGYTFT (650) | WVRQAPGQGLEWI G (653) | RVTMTVDTSISTAYMELSRLR SDDTAVYYCAK (663) | WGQGTLVTVSS (668) |
| 58 | QVQLVQSGAEVKKPGASVKV SCKGSGYTFT (649) | WVRQAPGQGLEWM G (654) | RATMTVDKSISTAYMELSRLR SDDTAVYYCAK (659) | WGQGTLVTVSS (668) |
| 59 | QVQLVQSGAEVKKPGASVKV SCKASGYTFT (648) | WVRQAPGQGLEWM G (654) | RVTMTVDKSISTAYMELSRLR SDDTAVYYCAK (662) | WGQGTLVTVSS (668) |
| 61 | QVQLVQSGTEVKKPGASVKV SCKASGYTFT (650) | WVRQAPGQGLEWM G (654) | RVTMTVDKSISTAYMELSRLR SDDTAVYYCAK (662) | WGQGTLVTVSS (668) |
| 68 | QVQLVQSGTEVKKPGASVKV SCKGSGYTFT (651) | WVRQAPGQGLEWI G (653) | RVTMTVDTSISTAYMELSRLR SDDTAVYYCAK (663) | WGQGTLVTVSS (668) |
| 70 | QVQLVQSGTEVKKPGASVKV SCKASGYTFT (650) | WVRQAPGQGMEWI G (655) | RATMTVDTSISTAYMELSRLR SDDTAVYYCAK (670) | WGQGTLVTVSS (668) |
| 71 | QVQLVQSGAEVKKPGASVKV SCKASGYTFT (648) | WVRQAPGQGMEWM G (656) | RATMTVDKSISTAYMELSRLR SDDTAVYYCAK (670) | WGQGTLVTVSS (668) |
| 75 | QVQLVQSGTEVKKPGASVKV SCKGSGYTFT (651) | WVRQAPGQGLEWI G (653) | RVTMTVDKSISTAYMELSRLR SDDTAVYYCAK (662) | WGQGTLVTVSS (668) |
| 76 | QVQLVQSGAGVKKPGASVKV SCKGSGYTFT (644) | WVRQAPGQGLEWM G (654) | RATMTVDKSISTAYMELSRLR SDDTAVYYCAK (659) | WGQGTLVTVSS (668) |
| 78 | QVQLVQSGAEVKKPGASVKV SCKGSGYTFT (649) | WVRQAPGQGLEWI G (653) | RATMTVDTSISTAYMELSRLR GDDTAVYYCAK (661) | WGRGTLVTVSS (669) |
| 79 | QVQLVQSGTEVKKPGASVKV SCKGSGYTFT (651) | WVRQAPGQGMEWM G (656) | RVTMTVDKSISTAYMELSRLR SDDTAVYYCAK (662) | WGQGTLVTVSS (668) |
| 80 | QVQLVQSGTEVKKPGASVKV SCKASGYTFT (650) | WVRQAPGQGMEWM G (656) | RVTMTVDTSISTAYMELSRLR SDDTAVYYCAK (663) | WGQGTLVTVSS (668) |

TABLE 8-continued

VH FR Amino Acid Sequences[4]

| Antibody | VH FR1 (SEQ ID NO:) | VH FR2 (SEQ ID NO:) | VH FR3 (SEQ ID NO:) | VH FR4 (SEQ ID NO:) |
|---|---|---|---|---|
| 85 | QVQLVQSGAEVKKPGASVKV SCKASGYTFT (648) | WVRQAPGQGLEWM G (654) | RATMTVDTSISTAYMELSRLR SDDTAVYYCAK (670) | WGQGTLVTVSS (668) |
| 86 | QVQLVQSGAEVKKPGASVKV SCKGSGYTFT (649) | WVRQAPGQGMEWM G (656) | RATMTVDTSISTAYMELSRLR SDDTAVYYCAK (670) | WGQGTLVTVSS (668) |
| 91 | QVQLVQSGTEVKKPGASVKV SCKGSGYTFT (651) | WVRQAPGQGMEWM G (656) | RATMTVDTSISTAYMELSRLR SDDTAVYYCAK (670) | WGQGTLVTVSS (668) |
| 92 | QVQLVQSGAEVKKPGASVKV SCKGSGYTFT (649) | WVRQAPGQGLEWM G (654) | RATMTVDTSISTAYMELSRLQ SDDTAVYYCAK (660) | WGQGTLVTVSS (668) |
| 94 | QVQLVQSGTEVKKPGASVKV SCKGSGYTFT (651) | WVRQAPGQGLEWI G (653) | RVTMTVDKSISTAYMELSRLR SDDTAVYYCAK (662) | WGQGTFVTVSS (666) |
| 95 | QVQLVQSGAEVKKPGASVKV SCKGSGYTFT (649) | WVRQAPGQGLEWM G (654) | RVTMTVDTSISTAYMELSRLR SDDTAVYYCAK (663) | WGQGTFVTVSS (666) |
| 96 | QVQLVQSGAEVKKPGASVKV SCKGSGYTFT (649) | WVRQAPGQGMEWM G (656) | RVTMTVDTSISTAYMELSRLR SDDTAVYYCAK (663) | WGQGTLVTVSS (668) |
| 97 | QVQLVQSGTEVKKPGASVKV SCKGSGYTFT (651) | WVRQAPGQGMEWI G (655) | RVTMTVDKSISTAYMELSRLR SDDTAVYYCAK (662) | WGQGTLVTVSS (668) |
| 101 | QVQLVQSGAEVKKPGASVKV SCKASGYTFT (648) | WVRQAPGQGLEWM G (654) | RVTMTVDKSISTAYMELSRLR SDDTAVYYCAK (662) | WGQGTLVTVSS (668) |
| 102 | QVQLVQSGTEVKKPGASVKV SCKASGYTFT (650) | WVRQAPGQGLEWI G (653) | RVTMTVDTSISTAYMELSRLR SDDTAVYYCAK (663) | WGQGTLVTVSS (668) |
| 105 | QVQLVQSGAEVKKPGASVKV SCKGSGYTFT (649) | WVRQAPGQGLEWM G (654) | RVTMTVDTSISTAYMELSRLR SDDTAVYYCAK (663) | WGQGTLVTVSS (668) |
| 107 | QVQLVQSGAEVKKPGASVKV SCKGSGYTFT (649) | WVRQAPGQGLEWM G (654) | RVTMTVDTSISTAYMELSRLR SDDTAVYYCAK (663) | WGQGTLVTVSS (668) |

[4]The VH framework regions described in Table 8 are determined based upon the boundaries of the Kabat numbering system for CDRs. In other words, the VH CDRs are determined by Kabat and the framework regions are the amino acid residues surrounding the CDRs in the variable region in the format FR1, CDR1, FR2, CDR2, FR3, CDR3, and FR4.

In another embodiment, an antibody described herein, or an antigen-binding fragment thereof, which specifically binds to GITR (e.g., human GITR), comprises:

(a) a VL CDR1 comprising, consisting of, or consisting essentially of the amino acid sequence KSSQSX$_1$X$_2$X$_3$X$_4$X$_5$X$_6$X$_7$KX$_8$YLX$_9$ (SEQ ID NO: 4), wherein:
$X_1$ is L, A, V, I, P, F or M
$X_2$ is L, A, V, I, P, F, M or S
$X_3$ is N, G, Q, S, T, C, W, Y or A
$X_4$ is S, G, N, Q, T, C, W, Y or A
$X_5$ is G, N, Q, S, T, C, W, Y or A
$X_6$ is N, G, Q, S, T, C, W, Y or A
$X_7$ is Q, G, N, S, T, C, W, Y or A
$X_8$ is N, G, Q, S, T, C, W, Y or A
$X_9$ is T, G, N, Q, S, C, W, Y, V, I or A; and/or (b) a VL CDR2 comprising, consisting of, or consisting essentially of the amino acid sequence X$_1$ASTRX$_2$X$_3$ (SEQ ID NO: 5), wherein:
$X_1$ is W, G, N, Q, S, T, C, Y, F, H or A
$X_2$ is E, D or A
$X_3$ is S, G, N, Q, T, C, W, Y or A; and/or (c) a VL CDR3 comprising, consisting of, or consisting essentially of the amino acid sequence QX$_1$X$_2$YX$_3$X$_4$PYT (SEQ ID NO: 6), wherein:
$X_1$ is N, G, Q, S, T, C, W or Y
$X_2$ is D, E or Y
$X_3$ is S, G, N, Q, T, C, W, Y or A
$X_4$ is Y, G, N, Q, S, T, C, W, F, H, L, or A; and/or (d) a VH CDR1 comprising, consisting of, or consisting essentially of the amino acid sequence X$_1$YX$_2$MX$_3$ (SEQ ID NO: 1), wherein
$X_1$ is D, E, G or A
$X_2$ is A, V, L, I, P, F, M or Y
$X_3$ is Y, G, N, Q, S, T, C, W, F or H; and/or (e) a VH CDR2 comprising, consisting of, or consisting essentially of the amino acid sequence X$_1$IX$_2$X$_3$X$_4$SGX$_5$X$_6$X$_7$YX$_8$QKFX$_9$X$_{10}$ (SEQ ID NO: 2), wherein
$X_1$ is V, A, L, I, P, F, M or T
$X_2$ is R, K, H, Q or A
$X_3$ is T, G, N, Q, S, C, W, Y, V, I or P
$X_4$ is Y, G, N, Q, S, T, C, W, F, H, or A
$X_5$ is D, E, G or A
$X_6$ is V, A, L, I, P, F, M or T
$X_7$ is T, G, N, Q, S, C, W, Y, V, I, P or A
$X_8$ is N, G, Q, S, T, C, W, Y or A
$X_9$ is K, R, H, Q or A
$X_{10}$ is D, E, G or A; and/or (f) a VH CDR3 comprising, consisting of, or consisting essentially of the amino acid sequence SGTVRGX$_1$X$_2$X$_3$ (SEQ ID NO: 3), wherein
$X_1$ is F, A, V, L, I, P, M, Y, W, H or S
$X_2$ is A, or D
$X_3$ is Y, G, N, Q, S, T, C, W, F, H or V.

In specific embodiments, the antibody or antigen-binding fragment thereof comprises one, two, three, four, five or all six of the CDRs above. In certain embodiments, the antibody or antigen-binding fragment thereof comprises the VL CDR1 of one of the antibodies in Table 1. In some embodiments, the antibody or antigen-binding fragment thereof comprises the VL CDR2 of one of the antibodies in Table 1. In certain embodiments, the antibody or antigen-binding fragment thereof comprises the VL CDR3 of one of the antibodies in Table 1. In some embodiments, the antibody or antigen-binding fragment thereof comprises the VH CDR1 of one of the antibodies in Table 2. In some embodiments, the antibody or antigen-binding fragment thereof comprises the VH CDR2 of one of the antibodies in Table 2. In certain embodiments, the antibody or antigen-binding fragment thereof comprises the VH CDR3 of one of the antibodies in Table 2. In some embodiments, the antibody or antigen-binding fragment thereof comprises one, two or all three of the VH CDRs of one of the antibodies in Table 2 (e.g., the VH CDRs in one row of Table 2, for example, all of the VH CDRs are from the antibody 231-32-15). In certain embodiments, the antibody or antigen-binding fragment thereof comprises one, two or all three of the VL CDRs of one of the antibodies in Table 1 (e.g., the VL CDRs in one row of Table 1, for example, all of the VLCDRs are from the antibody 231-32-15).

In another embodiment, an antibody described herein, or an antigen-binding fragment thereof, which specifically binds to GITR (e.g., human GITR), comprises a light chain variable region (VL) and a heavy chain variable region (VH), wherein (i) the VL comprises:

(a) a VL CDR1 comprising, consisting of, or consisting essentially of the amino acid sequence KSSQSX$_1$X$_2$X$_3$X$_4$X$_5$X$_6$X$_7$KX$_8$YLX$_9$ (SEQ ID NO: 4), wherein:

X$_1$ is L, A, V, I, P, F or M
X$_2$ is L, A, V, I, P, F, M or S
X$_3$ is N, G, Q, S, T, C, W, Y or A
X$_4$ is S, G, N, Q, T, C, W, Y or A
X$_5$ is G, N, Q, S, T, C, W, Y or A
X$_6$ is N, G, Q, S, T, C, W, Y or A
X$_7$ is Q, G, N, S, T, C, W, Y or A
X$_8$ is N, G, Q, S, T, C, W, Y or A
X$_9$ is T, G, N, Q, S, C, W, Y, V, I or A; and/or (b) a VL CDR2 comprising, consisting of, or consisting essentially of the amino acid sequence X$_1$ASTRX$_2$X$_3$ (SEQ ID NO: 5), wherein:

X$_1$ is W, G, N, Q, S, T, C, Y, F, H or A
X$_2$ is E, D or A
X$_3$ is S, G, N, Q, T, C, W, Y or A; and/or (c) a VL CDR3 comprising, consisting of, or consisting essentially of the amino acid sequence QX$_1$X$_2$YX$_3$X$_4$PYT (SEQ ID NO: 6), wherein:

X$_1$ is N, G, Q, S, T, C, W or Y
X$_2$ is D, E or Y
X$_3$ is S, G, N, Q, T, C, W, Y or A
X$_4$ is Y, G, N, Q, S, T, C, W, F, H, L, or A; and (ii) the VH comprises:

(a) a VH CDR1 comprising, consisting of, or consisting essentially of the amino acid sequence X$_1$YX$_2$MX$_3$ (SEQ ID NO: 1), wherein X$_1$ is D, E, G or A
X$_2$ is A, V, L, I, P, F, M or Y
X$_3$ is Y, G, N, Q, S, T, C, W, F or H; and/or (b) a VH CDR2 comprising, consisting of, or consisting essentially of the amino acid sequence X$_1$IX$_2$X$_3$X$_4$SGX$_5$X$_6$X$_7$YX$_8$QKFX$_9$X$_{10}$ (SEQ ID NO: 2), wherein X$_1$ is V, A, L, I, P, F, M or T
X$_2$ is R, K, H, Q or A
X$_3$ is T, G, N, Q, S, C, W, Y, V, I or P
X$_4$ is Y, G, N, Q, S, T, C, W, F, H, or A
X$_5$ is D, E, G or A
X$_6$ is V, A, L, I, P, F, M or T
X$_7$ is T, G, N, Q, S, C, W, Y, V, I, P or A
X$_8$ is N, G, Q, S, T, C, W, Y or A
X$_9$ is K, R, H, Q or A
X$_{10}$ is D, E, G or A; and/or (c) a VH CDR3 comprising, consisting of, or consisting essentially of the amino acid sequence SGTVRGX$_1$X$_2$X$_3$ (SEQ ID NO: 3), wherein X$_1$ is F, A, V, L, I, P, M, Y, W, H or S
X$_2$ is A, or D
X$_3$ is Y, G, N, Q, S, T, C, W, F, H or V.

In specific embodiments, the VL comprises two or all three of the VL CDRs above and/or the VH comprises two or all three of the VH CDRs above. In certain embodiments, the antibody or antigen-binding fragment thereof comprises the VL CDR1 of one of the antibodies in Table 1. In some embodiments, the antibody or antigen-binding fragment thereof comprises the VL CDR2 of one of the antibodies in Table 1. In certain embodiments, the antibody or antigen-binding fragment thereof comprises the VL CDR3 of one of the antibodies in Table 1. In some embodiments, the antibody or antigen-binding fragment thereof comprises the VH CDR1 of one of the antibodies in Table 2. In some embodiments, the antibody or antigen-binding fragment thereof comprises the VH CDR2 of one of the antibodies in Table 2. In certain embodiments, the antibody or antigen-binding fragment thereof comprises the VH CDR3 of one of the antibodies in Table 2. In some embodiments, the antibody or antigen-binding fragment thereof comprises one, two or all three of the VH CDRs of one of the antibodies in Table 2 (e.g., the VH CDRs in one row of Table 2). In certain embodiments, the antibody or antigen-binding fragment thereof comprises one, two or all three of the VL CDRs of one of the antibodies in Table 1 (e.g., the VL CDRs in one row in Table 1).

In another embodiment, an antibody or fragment thereof described herein, which specifically binds to GITR (e.g., human GITR), comprises a light chain variable region (VL) comprising:

(a) a VL CDR1 comprising, consisting of, or consisting essentially of the amino acid sequence KSSQSLLNSX$_1$NQKNYLX$_2$ (SEQ ID NO: 10), wherein X$_1$ is G or S
X$_2$ is T or S; and/or (b) a VL CDR2 comprising, consisting of, or consisting essentially of the amino acid sequence WASTRES (SEQ ID NO: 11); and/or (c) a VL CDR3 comprising, consisting of, or consisting essentially of the amino acid sequence QNX$_1$YSX$_2$PYT (SEQ ID NO: 12), wherein X$_1$ is D or E
X$_2$ is Y, F or S.

In specific embodiments, the antibody or antigen-binding fragment thereof comprises one, two, or all three of the VL CDRs above. In certain embodiments, the antibody or antigen-binding fragment thereof comprises the VL CDR1 of one of the antibodies in Table 1. In some embodiments, the antibody or antigen-binding fragment thereof comprises the VL CDR2 of one of the antibodies in Table 1. In certain embodiments, the antibody or antigen-binding fragment thereof comprises the VL CDR3 of one of the antibodies in Table 1. In certain embodiments, the antibody or antigen-binding fragment thereof comprises one, two or all three of the VL CDRs of one of the antibodies in Table 1 (e.g., the VL CDRs in one row of Table 1). In some embodiments, the antibody or antigen-binding fragment thereof comprises the VL framework regions described herein. In specific embodiments, the antibody or antigen-binding fragment thereof comprises the VL framework regions (FRs) of an antibody set forth in Table 3 (e.g., one, two, three, or four of the framework regions in one row of Table 3).

In another embodiment, an antibody or fragment thereof described herein, which specifically binds to GITR (e.g., human GITR), comprises a heavy chain variable region (VH) comprising:

(a) a VH CDR1 comprising, consisting of, or consisting essentially of the amino acid sequence $X_1YX_2MX_3$ (SEQ ID NO: 7), wherein
$X_1$ is D, E or G
$X_2$ is A or V
$X_3$ is Y or H; and/or (b) a VH CDR2 comprising, consisting of, or consisting essentially of the amino acid sequence $X_1IX_2TX_3SGX_4X_5X_6YNQKFX_7X_8$ (SEQ ID NO: 8), wherein
$X_1$ is V or L
$X_2$ is R, K or Q
$X_3$ is Y or F
$X_4$ is D, E or G
$X_5$ is V or L
$X_6$ is T or S
$X_7$ is K, R or Q
$X_8$ is D, E or G; and/or (c) a VH CDR3 comprising, consisting of, or consisting essentially of the amino acid sequence SGTVRGFAY (SEQ ID NO: 9).

In specific embodiments, the antibody or antigen-binding fragment thereof comprises one, two or all three of the VH CDRs above. In certain embodiments, the antibody or antigen-binding fragment thereof comprises the VH CDR1 of one of the antibodies in Table 2. In some embodiments, the antibody or antigen-binding fragment thereof comprises the VH CDR2 of one of the antibodies in Table 2. In certain embodiments, the antibody or antigen-binding fragment thereof comprises the VH CDR3 of one of the antibodies in Table 2. In some embodiments, the antibody or antigen-binding fragment thereof comprises one, two or all three of the VH CDRs of one of the antibodies in Table 2 (e.g., the VH CDRs in one row in Table 2). In some embodiments, the antibody or antigen-binding fragment thereof comprises one, two or all three of the VH CDRs of one of the antibodies in Table 2. In some embodiments, the antibody or antigen-binding fragment thereof comprises the VH frameworks described herein. In specific embodiments, the antibody or antigen-binding fragment thereof comprises the VH framework regions of an antibody set forth in Tables 4 (e.g., one, two, three or four of the framework regions in one row of Table 4).

In a particular embodiment, an antibody described herein, or an antigen-binding fragment thereof, which specifically binds to GITR (e.g., human GITR), comprises:

(a) a VL CDR1 comprising, consisting of, or consisting essentially of the amino acid sequence $KSSQSLLNSX_1NQKNYLX_2$ (SEQ ID NO: 10), wherein $X_1$ is G or S
$X_2$ is T or S; and/or (b) a VL CDR2 comprising, consisting of, or consisting essentially of the amino acid sequence WASTRES (SEQ ID NO: 11); and/or (c) a VL CDR3 comprising, consisting of, or consisting essentially of the amino acid sequence $QNX_1YSX_2PYT$ (SEQ ID NO: 12), wherein
$X_1$ is D or E
$X_2$ is Y, F or S.

(d) a VH CDR1 comprising, consisting of, or consisting essentially of the amino acid sequence $X_1YX_2MX_3$ (SEQ ID NO: 7), wherein
$X_1$ is D, E or G
$X_2$ is A or V
$X_3$ is Y or H; and/or (e) a VH CDR2 comprising, consisting of, or consisting essentially of the amino acid sequence $X_1IX_2TX_3SGX_4X_5X_6YNQKFX_7X_8$ (SEQ ID NO: 8), wherein
$X_1$ is V or L
$X_2$ is R, K or Q
$X_3$ is Y or F
$X_4$ is D, E or G
$X_5$ is V or L
$X_6$ is T or S
$X_7$ is K, R or Q
$X_8$ is D, E or G; and/or (f) a VH CDR3 comprising, consisting of, or consisting essentially of the amino acid sequence SGTVRGFAY (SEQ ID NO: 9).

In specific embodiments, the antibody or antigen-binding fragment thereof comprises one, two, three, four, five or all six of the CDRs above. In certain embodiments, the antibody or antigen-binding fragment thereof comprises the VL CDR1 of one of the antibodies in Table 1. In some embodiments, the antibody or antigen-binding fragment thereof comprises the VL CDR2 of one of the antibodies in Table 1. In certain embodiments, the antibody or antigen-binding fragment thereof comprises the VL CDR3 of one of the antibodies in Table 1. In some embodiments, the antibody or antigen-binding fragment thereof comprises the VH CDR1 of one of the antibodies in Table 2. In some embodiments, the antibody or antigen-binding fragment thereof comprises the VH CDR2 of one of the antibodies in Table 2. In certain embodiments, the antibody or antigen-binding fragment thereof comprises the VH CDR3 of one of the antibodies in Table 2. In some embodiments, the antibody or antigen-binding fragment thereof comprises one, two or all three of the VH CDRs of one of the antibodies in Table 2 (e.g., the VH CDRs in one row in Table 2). In certain embodiments, the antibody or antigen-binding fragment thereof comprises one, two or all three of the VL CDRs of one of the antibodies in Table 1 (e.g., the VL CDRs in one row in Table 1).

In a particular embodiment, an antibody or fragment thereof described herein, which specifically binds to GITR (e.g., human GITR), comprises a light chain variable region (VL) and a heavy chain variable region (VH), wherein
(i) the VL comprises:

(a) a VL CDR1 comprising, consisting of, or consisting essentially of the amino acid sequence $KSSQSLLNSX_1NQKNYLX_2$ (SEQ ID NO: 10), wherein
$X_1$ is G or S
$X_2$ is T or S; and/or (b) a VL CDR2 comprising, consisting of, or consisting essentially of the amino acid sequence WASTRES (SEQ ID NO: 11); and/or (c) a VL CDR3 comprising, consisting of, or consisting essentially of the amino acid sequence QNX$_1$YSX$_2$PYT (SEQ ID NO: 12), wherein
  X$_1$ is D or E
  X$_2$ is Y, F or S; and
(ii) the VH comprises:
  (a) a VH CDR1 comprising, consisting of, or consisting essentially of the amino acid sequence X$_1$YX$_2$MX$_3$ (SEQ ID NO: 7), wherein
    X$_1$ is D, E or G
    X$_2$ is A or V
    X$_3$ is Y or H; and/or
  (b) a VH CDR2 comprising, consisting of, or consisting essentially of the amino acid sequence X$_1$IX$_2$TX$_3$SGX$_4$X$_5$X$_6$YNQKFX$_7$X$_8$ (SEQ ID NO: 8), wherein
    X$_1$ is V or L
    X$_2$ is R, K or Q
    X$_3$ is Y or F
    X$_4$ is D, E or G
    X$_5$ is V or L
    X$_6$ is T or S
    X$_7$ is K, R or Q
    X$_8$ is D, E or G; and/or
  (c) a VH CDR3 comprising, consisting of, or consisting essentially of the amino acid sequence SGTVRGFAY (SEQ ID NO: 9).

In specific embodiments, the VL comprises two or all three of the VL CDRs above and/or the VH comprises two or all three of the VH CDRs above. In certain embodiments, the antibody or antigen-binding fragment thereof comprises the VL CDR1 of one of the antibodies in Table 1. In some embodiments, the antibody or antigen-binding fragment thereof comprises the VL CDR2 of one of the antibodies in Table 1. In certain embodiments, the antibody or antigen-binding fragment thereof comprises the VL CDR3 of one of the antibodies in Table 1. In some embodiments, the antibody or antigen-binding fragment thereof comprises the VH CDR1 of one of the antibodies in Table 2. In some embodiments, the antibody or antigen-binding fragment thereof comprises the VH CDR2 of one of the antibodies in Table 2. In certain embodiments, the antibody or antigen-binding fragment thereof comprises the VH CDR3 of one of the antibodies in Table 2. In some embodiments, the antibody or antigen-binding fragment thereof comprises one, two or all three of the VH CDRs of one of the antibodies in Table 2 (e.g., the VH CDRs in one row in Table 2). In certain embodiments, the antibody or antigen-binding fragment thereof comprises one, two or all three of the VL CDRs of one of the antibodies in Table 1 (e.g., the VL CDRs in one row in Table 1).

In a particular embodiment, an antibody or fragment thereof described herein, which specifically binds to GITR (e.g., human GITR), comprises a light chain variable region (VL) and a heavy chain variable region (VH), wherein
(i) the VL comprises:
  (a) a VL CDR1 comprising, consisting of, or consisting essentially of the amino acid sequence KSSQSLLNSX$_1$NQKNYLX$_2$ (SEQ ID NO: 10), wherein
    X$_1$ is G or S
    X$_2$ is T or S; and/or
  (b) a VL CDR2 comprising, consisting of, or consisting essentially of the amino acid sequence WASTRES (SEQ ID NO: 11); and/or
  (c) a VL CDR3 comprising, consisting of, or consisting essentially of the amino acid sequence QNX$_1$YSX$_2$PYT (SEQ ID NO: 12), wherein
    X$_1$ is D or E
    X$_2$ is Y, F, or S; and
(ii) the VH comprises:
  (a) a VH CDR1 comprising, consisting of, or consisting essentially of the amino acid sequence X$_1$YX$_2$MX$_3$ (SEQ ID NO: 7), wherein
    X$_1$ is D, E or G
    X$_2$ is A or V
    X$_3$ is Y or H; and/or
  (b) a VH CDR2 comprising, consisting of, or consisting essentially of the amino acid sequence X$_1$IX$_2$TX$_3$SGX$_4$X$_5$X$_6$YNQKFX$_7$X$_8$ (SEQ ID NO: 8), wherein
    X$_1$ is V or L
    X$_2$ is R, K or Q
    X$_3$ is Y or F
    X$_4$ is D, E or G
    X$_5$ is V or L
    X$_6$ is T or S
    X$_7$ is K, R or Q
    X$_8$ is D, E or G; and/or
  (c) a VH CDR3 comprising, consisting of, or consisting essentially of the amino acid sequence of SGTVRGX$_1$X$_2$X$_3$ (SEQ ID NO: 3), wherein
    X$_1$ is F, A, V, L, I, P, M, Y, W, H or S
    X$_2$ is A or D
    X$_3$ is Y, G, N, Q, S, T, C, W, F, H or V.

In certain embodiments, provided herein is an antibody or fragment thereof which specifically binds to GITR (e.g., human GITR) and comprises one, two or three of the light chain variable region (VL) complementarity determining regions (CDRs) of an antibody in Table 1 (e.g., the VL CDRs in one row of Table 1). In some embodiments, provided herein is an antibody or fragment thereof which specifically binds to GITR (e.g., human GITR) and comprises one, two or three of the heavy chain variable region (VH) CDRs of any one of any one of antibodies in Table 2 (e.g., the VH CDRs in one row of Table 2).

In certain embodiments, provided herein is an antibody or fragment thereof which specifically binds to GITR (e.g., human GITR) and comprises a light chain variable region (VL) comprising one, two or all three of the VL CDRs of an antibody in Table 1 (e.g., the VL CDRs in one row of Table 1). In some embodiments, the antibody or antigen-binding fragment thereof comprises one, two, three or all four of the VL framework regions described herein. In specific embodiments, the antibody or antigen-binding fragment thereof comprises one, two, three or all four of the VL framework regions (FRs) set forth in Table 3 (e.g., one, two, three or four of the framework regions in one row in Table 3).

In certain embodiments, provided herein is an antibody or fragment thereof which specifically binds to GITR (e.g., human GITR) and comprises a heavy chain variable region (VH) comprising one, two or all three of the VH CDRs of an antibody in Table 2 (e.g., the VH CDRs in one row of Table 2). In some embodiments, the antibody or antigen-binding fragment thereof comprises one, two, three or all four of the VH framework regions described herein. In specific embodiments, the antibody or antigen-binding fragment thereof comprises one, two, three or all four of the VH framework regions (FRs) set forth in Table 4 (e.g., one, two, three, or four of the framework regions in one row in Table 4).

In certain embodiments, provided herein is an antibody or fragment thereof which specifically binds to GITR (e.g., human GITR) and comprises light chain variable region (VL) CDRs and heavy chain variable region (VH) CDRs of any one of antibodies Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15 or antibodies 1-107, or antibodies pab2159, pab2160, or pab2161, for example as set forth in Tables 1 and 2 (e.g., the VH CDRs and VL CDRs in the same row are all from the same antibody as designated by the name of the antibody in the first column of Tables 1 and 2, for example, the VL CDRs and VH CDRs in the first row of Tables 1 and 2 respectively are all from antibody 231-32-15). In some embodiments, the antibody or antigen-binding fragment thereof comprises the VL framework regions and VH frameworks described herein. In specific embodiments, the antibody or antigen-binding fragment thereof comprises VL framework regions (FRs) and VH framework regions set forth in Tables 3 and 4 (e.g., the VL FRs and VH FRs are all from the same antibody).

In a particular embodiment, an antibody described herein, or an antigen-binding fragment thereof, which specifically binds to GITR (e.g., human GITR), comprises a light chain variable region (VL) comprising VL CDR1, VL CDR2, and VL CDR3 as set forth in Table 1, for example, VL CDR1, VL CDR2, and VL CDR3 of any one of antibodies Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15 or antibodies 1-107, or antibodies pab2159, pab2160, or pab2161, (e.g., the VL CDRs are in one row of Table 1). In some embodiments, the antibody or antigen-binding fragment thereof comprises VL framework regions of an antibody set forth in Table 3 (e.g., one, two, three, or four of the framework regions in one row in Table 3). In certain embodiments, the antibody or antigen-binding fragment thereof comprises a light chain variable region sequence comprising one, two, three or four of the framework regions of the light chain variable region sequence of SEQ ID NO: 204 or SEQ ID NO: 205. In some embodiments, the antibody or antigen-binding fragment thereof comprises one, two, three or four of the framework regions of a light chain variable region sequence which is at least 75%, 80%, 85%, 90%, 95%, or 100% identical to one, two, three or four of the framework regions of a light chain variable region sequence selected from the group consisting of SEQ ID NO: 202, SEQ ID NO: 207, SEQ ID NO: 208, and SEQ ID NOs: 400-518. In some embodiments, the antibody or antigen-binding fragment thereof comprises one, two, three or four of the framework regions of a light chain variable region sequence which is at least 75%, 80%, 85%, 90%, 95%, or 100% identical to one, two, three or four of the framework regions of the light chain variable region sequence of SEQ ID NO: 519. In certain embodiments, an antibody or antigen-binding fragment thereof comprises a light chain variable framework region that is or is derived from an amino acid sequence encoded by a human gene, wherein the amino acid sequence is selected from the group consisting of IGKV4-1*01 (SEQ ID NO: 607) and IGKV3-7*02 (SEQ ID NO: 608). In specific embodiments, the light chain variable framework region that is derived from said amino acid sequence consists of said amino acid sequence but for the presence of up to 10 amino acid substitutions, deletions, and/or insertions, preferably up to 10 amino acid substitutions. In a particular embodiment, the light chain variable framework region that is derived from said amino acid sequence consists of said amino acid sequence with 1, 2, 3, 4, 5, 6, 7, 8, 9 or 10 amino acid residues being substituted for an amino acid found in an analogous position in a corresponding non-human light chain variable framework region. In some embodiments, an antibody or antigen-binding fragment thereof comprises a light chain variable framework region that is derived from amino acid sequence SEQ ID NO: 607 or SEQ ID NO: 608, wherein at least one amino acid in amino acid sequence SEQ ID NO: 607 or SEQ ID NO: 608 is substituted with an amino acid in an analogous position in a corresponding non-human light chain variable framework region. In a specific embodiment, the amino acid substitution is at amino acid position 87, wherein the amino acid position is indicated according to the Kabat numbering. In particular embodiments, the amino acid substitution is 87H, wherein the amino acid position is indicated according to the Kabat numbering.

In a particular embodiment, an antibody or fragment thereof described herein, which specifically binds to GITR (e.g., human GITR), comprises the VL CDR1, VL CDR2, and VL CDR3 of Hum231#1, for example, the VL CDR1, VL CDR2, and VL CDR3 of Hum231#1 as set forth in Table 1 (SEQ ID NOS: 16, 17, and 18, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of Hum231#1).

In a particular embodiment, an antibody or fragment thereof described herein, which specifically binds to GITR (e.g., human GITR), comprises the VL CDR1, VL CDR2, and VL CDR3 of Hum231#2, for example, the VL CDR1, VL CDR2, and VL CDR3 of Hum231#2 as set forth in Table 1 (SEQ ID NOS: 16, 17, and 18, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of Hum231#2).

In a particular embodiment, an antibody or fragment thereof described herein, which specifically binds to GITR (e.g., human GITR), comprises the VL CDR1, VL CDR2, and VL CDR3 of pab1964, for example, the VL CDR1, VL CDR2, and VL CDR3 of pab1964 as set forth in Table 1 (SEQ ID NOS: 101, 105, and 106, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1964).

In a particular embodiment, an antibody or fragment thereof described herein, which specifically binds to GITR (e.g., human GITR), comprises the VL CDR1, VL CDR2, and VL CDR3 of A pab1965, for example, the VL CDR1, VL CDR2, and VL CDR3 of pab1965 as set forth in Table 1 (SEQ ID NOS: 102, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1965).

In a particular embodiment, an antibody or fragment thereof described herein, which specifically binds to GITR (e.g., human GITR), comprises the VL CDR1, VL CDR2, and VL CDR3 of pab1966, for example, the VL CDR1, VL CDR2, and VL CDR3 of pab1966 as set forth in Table 1 (SEQ ID NOS: 102, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1966).

In a particular embodiment, an antibody or fragment thereof described herein, which specifically binds to GITR (e.g., human GITR), comprises the VL CDR1, VL CDR2, and VL CDR3 of pab1967, for example, the VL CDR1, VL CDR2, and VL CDR3 of pab1967 as set forth in Table 1 (SEQ ID NOS: 103, 105, and 108, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1967).

In a particular embodiment, an antibody or fragment thereof described herein, which specifically binds to GITR (e.g., human GITR), comprises the VL CDR1, VL CDR2, and VL CDR3 of pab1968, for example, the VL CDR1, VL CDR2, and VL CDR3 of pab1968 as set forth in Table 1 (SEQ ID NOS: 101, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1968).

In a particular embodiment, an antibody or fragment thereof described herein, which specifically binds to GITR (e.g., human GITR), comprises the VL CDR1, VL CDR2, and VL CDR3 of pab1969, for example, the VL CDR1, VL CDR2, and VL CDR3 of pab1969 as set forth in Table 1 (SEQ ID NOS: 103, 105, and 109, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1969).

In a particular embodiment, an antibody or fragment thereof described herein, which specifically binds to GITR (e.g., human GITR), comprises the VL CDR1, VL CDR2, and VL CDR3 of pab1970, for example, the VL CDR1, VL CDR2, and VL CDR3 of pab1970 as set forth in Table 1 (SEQ ID NOS: 101, 105, and 109, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1970).

In a particular embodiment, an antibody or fragment thereof described herein, which specifically binds to GITR (e.g., human GITR), comprises the VL CDR1, VL CDR2, and VL CDR3 of pab1971, for example, the VL CDR1, VL CDR2, and VL CDR3 of pab1971 as set forth in Table 1 (SEQ ID NOS: 103, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1971).

In a particular embodiment, an antibody or fragment thereof described herein, which specifically binds to GITR (e.g., human GITR), comprises the VL CDR1, VL CDR2, and VL CDR3 of pab1972, for example, the VL CDR1, VL CDR2, and VL CDR3 of pab1972 as set forth in Table 1 (SEQ ID NOS: 104, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1972).

In a particular embodiment, an antibody or fragment thereof described herein, which specifically binds to GITR (e.g., human GITR), comprises the VL CDR1, VL CDR2, and VL CDR3 of pab1973, for example, the VL CDR1, VL CDR2, and VL CDR3 of pab1973 as set forth in Table 1 (SEQ ID NOS: 103, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1973).

In a particular embodiment, an antibody or fragment thereof described herein, which specifically binds to GITR (e.g., human GITR), comprises the VL CDR1, VL CDR2, and VL CDR3 of pab1975, for example, the VL CDR1, VL CDR2, and VL CDR3 of pab1975 as set forth in Table 1 (SEQ ID NOS: 102, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1975).

In a particular embodiment, an antibody or fragment thereof described herein, which specifically binds to GITR (e.g., human GITR), comprises the VL CDR1, VL CDR2, and VL CDR3 of pab1976, for example, the VL CDR1, VL CDR2, and VL CDR3 of pab1976 as set forth in Table 1 (SEQ ID NOS: 101, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1976).

In a particular embodiment, an antibody or fragment thereof described herein, which specifically binds to GITR (e.g., human GITR), comprises the VL CDR1, VL CDR2, and VL CDR3 of pab1977, for example, the VL CDR1, VL CDR2, and VL CDR3 of pab1977 as set forth in Table 1 (SEQ ID NOS: 103, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1977).

In a particular embodiment, an antibody or fragment thereof described herein, which specifically binds to GITR (e.g., human GITR), comprises the VL CDR1, VL CDR2, and VL CDR3 of pab1979, for example, the VL CDR1, VL CDR2, and VL CDR3 of pab1979 as set forth in Table 1 (SEQ ID NOS: 102, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1979).

In a particular embodiment, an antibody or fragment thereof described herein, which specifically binds to GITR (e.g., human GITR), comprises the VL CDR1, VL CDR2, and VL CDR3 of pab1980, for example, the VL CDR1, VL CDR2, and VL CDR3 of pab1980 as set forth in Table 1 (SEQ ID NOS: 101, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1980).

In a particular embodiment, an antibody or fragment thereof described herein, which specifically binds to GITR (e.g., human GITR), comprises the VL CDR1, VL CDR2, and VL CDR3 of pab1981, for example, the VL CDR1, VL CDR2, and VL CDR3 of pab1981 as set forth in Table 1 (SEQ ID NOS: 103, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1981).

In a particular embodiment, an antibody or fragment thereof described herein, which specifically binds to GITR (e.g., human GITR), comprises the VL CDR1, VL CDR2, and VL CDR3 of pab1983, for example, the VL CDR1, VL CDR2, and VL CDR3 of pab1983 as set forth in Table 1 (SEQ ID NOS: 102, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab1983).

In a particular embodiment, an antibody or fragment thereof described herein, which specifically binds to GITR (e.g., human GITR), comprises the VL CDR1, VL CDR2, and VL CDR3 of pab2159, for example, the VL CDR1, VL CDR2, and VL CDR3 of pab2159 as set forth in Table 1 (SEQ ID NOS: 102, 105, and 109, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab2159). In a particular embodiment, an antibody or fragment thereof described herein, which specifically binds to GITR (e.g., human GITR), comprises the VL CDR1, VL CDR2, and VL CDR3 of pab2160, for example, the VL CDR1, VL CDR2, and VL CDR3 of pab2160 as set forth in Table 1 (SEQ ID NOS: 102, 105, and 107, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab2160).

In a particular embodiment, an antibody or fragment thereof described herein, which specifically binds to GITR (e.g., human GITR), comprises the VL CDR1, VL CDR2, and VL CDR3 of pab2161, for example, the VL CDR1, VL CDR2, and VL CDR3 of pab2161 as set forth in Table 1 (SEQ ID NOS: 103, 105, and 109, respectively). In certain embodiments, the antibody or antigen-binding fragment further comprises one, two, three or all four VL framework regions derived from the VL of a human or primate antibody. In specific embodiments, the antibody or antigen-binding fragment further comprises one, two, three or all four VL framework regions derived from a human light chain variable kappa subfamily. In some embodiments, the antibody or antigen-binding fragment thereof comprises VL framework regions of an antibody set forth in Table 3 (e.g., the framework regions of pab2161).

In a particular embodiment, an antibody described herein, or an antigen-binding fragment thereof, which specifically binds to GITR (e.g., human GITR), comprises a heavy chain variable region (VH) comprising VH CDR1, VH CDR2, and VH CDR3 as set forth in Table 2, for example, VH CDR1, VH CDR2, and VH CDR3 of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161, (e.g., the VH CDRs in one row in Table 2). In some embodiments, the antibody or antigen-binding fragment thereof comprises VH framework regions of an antibody set forth in Table 4 (e.g., one, two, three, or four of the framework regions in one row in Table 4). In certain embodiments, the antibody or antigen-binding fragment thereof comprises one, two, three or all four of the framework regions of the heavy chain variable region sequence of SEQ ID NO: 203. In some embodiments, the antibody or antigen-binding fragment thereof comprises one, two, three, or four of the framework regions of a heavy chain variable region sequence which is at least 75%, 80%, 85%, 90%, 95% or 100% identical to one, two, three or four of the framework regions of a heavy chain variable region sequence selected from the group consisting of SEQ ID NO: 201, SEQ ID NO: 206, and SEQ ID NOS: 215 to 389. In certain embodiments, the antibody or antigen-binding fragment thereof comprises a heavy chain variable framework region that is or is derived from an amino acid sequence encoded by a human gene, wherein the amino acid sequence is selected from the group consisting of IGHV1-2*02 (SEQ ID NO: 601), IGHV1-3*01 (SEQ ID NO: 602), IGHV1-46*01 (SEQ ID NO: 603), IGHV1-18*01 (SEQ ID NO: 604), IGHV1-69*01 (SEQ ID NO: 605), and IGHV7-4-1*02 (SEQ ID NO: 606). In specific embodiments, the heavy chain variable framework region that is derived from said amino acid sequence consists of said amino acid sequence but for the presence of up to 10 amino acid substitutions, deletions, and/or insertions, preferably up to 10 amino acid substitutions. In a particular embodiment, the heavy chain variable framework region that is derived from said amino acid sequence consists of said amino acid sequence with 1, 2, 3, 4, 5, 6, 7, 8, 9 or 10 amino acid residues being substituted for an amino acid found in an analogous position in a corresponding non-human heavy chain variable framework region. In specific embodiments, the antibody or antigen-binding fragment thereof comprises a heavy chain variable framework region that is derived from amino acid sequence SEQ ID NO: 601, wherein at least one amino acid of amino acid sequence SEQ ID NO: 601 is substituted with an amino acid in an analogous position in a corresponding non-human heavy chain variable framework region. In certain embodiments, the amino acid substitution is at an amino acid position selected from the group consisting of 24, 48, 67, 71, 73, and 94, wherein the amino acid position of each group member is indicated according to the Kabat numbering. In specific embodiments, the amino acid substitution selected from the group consisting of 24G, 48I, 67A, 71V, 73K, and 94K, wherein the amino acid position of each group member is indicated according to the Kabat numbering.

In a particular embodiment, an antibody or fragment thereof described herein, which specifically binds to GITR (e.g., human GITR), comprises the VH CDR1, VH CDR2, and VH CDR3 of Hum231#1, for example, the VH CDR1, VH CDR2, and VH CDR3 of Hum231#1 as set forth in Table 2 (SEQ ID NOS: 13, 14, and 15, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of Hum231#1).

In a particular embodiment, an antibody or fragment thereof described herein, which specifically binds to GITR (e.g., human GITR), comprises the VH CDR1, VH CDR2, and VH CDR3 of Hum231#2, for example, the VH CDR1, VH CDR2, and VH CDR3 of Hum231#2 as set forth in Table 2 (SEQ ID NOS: 13, 14, and 15, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of Hum231#2).

In a particular embodiment, an antibody or fragment thereof described herein, which specifically binds to GITR (e.g., human GITR), comprises the VH CDR1, VH CDR2, and VH CDR3 of pab1964, for example, the VH CDR1, VH CDR2, and VH CDR3 of pab1964 as set forth in Table 2 (SEQ ID NOS: 19, 24, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1964).

In a particular embodiment, an antibody or fragment thereof described herein, which specifically binds to GITR (e.g., human GITR), comprises the VH CDR1, VH CDR2, and VH CDR3 of pab1965, for example, the VH CDR1, VH CDR2, and VH CDR3 of pab1965 as set forth in Table 2 (SEQ ID NOS: 19, 25, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1965).

In a particular embodiment, an antibody or fragment thereof described herein, which specifically binds to GITR (e.g., human GITR), comprises the VH CDR1, VH CDR2, and VH CDR3 of pab1966, for example, the VH CDR1, VH CDR2, and VH CDR3 of pab1966 as set forth in Table 2 (SEQ ID NOS: 19, 26, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1966).

In a particular embodiment, an antibody or fragment thereof described herein, which specifically binds to GITR (e.g., human GITR), comprises the VH CDR1, VH CDR2, and VH CDR3 of pab1967, for example, the VH CDR1, VH CDR2, and VH CDR3 of pab1967 as set forth in Table 2 (SEQ ID NOS: 20, 27, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1967).

In a particular embodiment, an antibody or fragment thereof described herein, which specifically binds to GITR (e.g., human GITR), comprises the VH CDR1, VH CDR2, and VH CDR3 of pab1968, for example, the VH CDR1, VH CDR2, and VH CDR3 of pab1968 as set forth in Table 2 (SEQ ID NOS: 21, 28, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1968).

In a particular embodiment, an antibody or fragment thereof described herein, which specifically binds to GITR (e.g., human GITR), comprises the VH CDR1, VH CDR2, and VH CDR3 of pab1969, for example, the VH CDR1, VH CDR2, and VH CDR3 of pab1969 as set forth in Table 2 (SEQ ID NOS: 22, 29, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1969).

In a particular embodiment, an antibody or fragment thereof described herein, which specifically binds to GITR (e.g., human GITR), comprises the VH CDR1, VH CDR2, and VH CDR3 of pab1970, for example, the VH CDR1, VH CDR2, and VH CDR3 of pab1970 as set forth in Table 2 (SEQ ID NOS: 21, 24, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1970).

In a particular embodiment, an antibody or fragment thereof described herein, which specifically binds to GITR (e.g., human GITR), comprises the VH CDR1, VH CDR2, and VH CDR3 of pab1971, for example, the VH CDR1, VH CDR2, and VH CDR3 of pab1971 as set forth in Table 2 (SEQ ID NOS: 21, 177, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1971).

In a particular embodiment, an antibody or fragment thereof described herein, which specifically binds to GITR (e.g., human GITR), comprises the VH CDR1, VH CDR2, and VH CDR3 of pab1972, for example, the VH CDR1, VH CDR2, and VH CDR3 of pab1972 as set forth in Table 2 (SEQ ID NOS: 23, 31, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1972).

In a particular embodiment, an antibody or fragment thereof described herein, which specifically binds to GITR (e.g., human GITR), comprises the VH CDR1, VH CDR2, and VH CDR3 of pab1973, for example, the VH CDR1, VH CDR2, and VH CDR3 of pab1973 as set forth in Table 2 (SEQ ID NOS: 19, 32, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1973).

In a particular embodiment, an antibody or fragment thereof described herein, which specifically binds to GITR (e.g., human GITR), comprises the VH CDR1, VH CDR2, and VH CDR3 of pab1975, for example, the VH CDR1, VH CDR2, and VH CDR3 of pab1975 as set forth in Table 2 (SEQ ID NOS: 22, 29, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1975).

In a particular embodiment, an antibody or fragment thereof described herein, which specifically binds to GITR (e.g., human GITR), comprises the VH CDR1, VH CDR2, and VH CDR3 of pab1976, for example, the VH CDR1, VH CDR2, and VH CDR3 of pab1976 as set forth in Table 2 (SEQ ID NOS: 22, 29, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1976).

In a particular embodiment, an antibody or fragment thereof described herein, which specifically binds to GITR (e.g., human GITR), comprises the VH CDR1, VH CDR2, and VH CDR3 of pab1977, for example, the VH CDR1, VH CDR2, and VH CDR3 of pab1977 as set forth in Table 2 (SEQ ID NOS: 22, 29, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1977).

In a particular embodiment, an antibody or fragment thereof described herein, which specifically binds to GITR (e.g., human GITR), comprises the VH CDR1, VH CDR2, and VH CDR3 of pab1979, for example, the VH CDR1, VH CDR2, and VH CDR3 of pab1979 as set forth in Table 2 (SEQ ID NOS: 22, 33, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1979).

In a particular embodiment, an antibody or fragment thereof described herein, which specifically binds to GITR (e.g., human GITR), comprises the VH CDR1, VH CDR2, and VH CDR3 of pab1980, for example, the VH CDR1, VH CDR2, and VH CDR3 of pab1980 as set forth in Table 2 (SEQ ID NOS: 22, 33, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1980).

In a particular embodiment, an antibody or fragment thereof described herein, which specifically binds to GITR (e.g., human GITR), comprises the VH CDR1, VH CDR2, and VH CDR3 of pab1981, for example, the VH CDR1, VH CDR2, and VH CDR3 of pab1981 as set forth in Table 2 (SEQ ID NOS: 22, 33, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1981).

In a particular embodiment, an antibody or fragment thereof described herein, which specifically binds to GITR (e.g., human GITR), comprises the VH CDR1, VH CDR2, and VH CDR3 of pab1983, for example, the VH CDR1, VH CDR2, and VH CDR3 of pab1983 as set forth in Table 2 (SEQ ID NOS: 19, 24, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab1983).

In a particular embodiment, an antibody or fragment thereof described herein, which specifically binds to GITR (e.g., human GITR), comprises the VH CDR1, VH CDR2, and VH CDR3 of pab2159, for example, the VH CDR1, VH CDR2, and VH CDR3 of pab2159 as set forth in Table 2 (SEQ ID NOS: 19, 144, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab2159).

In a particular embodiment, an antibody or fragment thereof described herein, which specifically binds to GITR (e.g., human GITR), comprises the VH CDR1, VH CDR2, and VH CDR3 of pab2160, for example, the VH CDR1, VH CDR2, and VH CDR3 of pab2160 as set forth in Table 2 (SEQ ID NOS: 119, 162, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab2160).

In a particular embodiment, an antibody or fragment thereof described herein, which specifically binds to GITR (e.g., human GITR), comprises the VH CDR1, VH CDR2, and VH CDR3 of pab2161, for example, the VH CDR1, VH CDR2, and VH CDR3 of pab2161 as set forth in Table 2 (SEQ ID NOS: 22, 121, and 34, respectively). In certain embodiments, the antibody or antigen-binding fragment further comprises one, two, three or all four VH framework regions derived from the VH of a human or primate antibody. In specific embodiments, the antibody or antigen-binding fragment further comprises one, two, three or all four VH framework regions derived from a human heavy chain variable subfamily (e.g., one of subfamilies 1 to 7). In some embodiments, the antibody or antigen-binding fragment thereof comprises VH framework regions of an antibody set forth in Table 4 (e.g., the framework regions of pab2161).

In a particular embodiment, an antibody described herein, or an antigen-binding fragment thereof, which specifically binds to GITR (e.g., human GITR), comprises (i) a heavy chain variable region (VH) comprising VH CDR1, VH CDR2, and VH CDR3 as set forth in Table 2, for example, VH CDR1, VH CDR2, and VH CDR3 of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161, (e.g. the VH CDRs in one row in Table 2), and (ii) a light chain variable region (VL) comprising VL CDR1, VL CDR2, and VL CDR3 as set forth in Table 1, for example, VL CDR1, VL CDR2, and VL CDR3 of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161, (e.g., the VL CDRs in one row in Table 1). In some embodiments, the antibody or antigen-binding fragment thereof comprises VL framework regions and VH framework regions of an antibody set forth in Tables 3 and 4, respectively (e.g., the framework regions of a single antibody as designated by its name, for example, all of the FRs are from Hum231#1 or Hum231#2).

In some embodiments, the antibody or antigen-binding fragment thereof described herein comprises one, two, three or four framework regions of a heavy chain variable region sequence which is at least 75%, 80%, 85%, 90%, 95% or 100% identical to one, two, three or four of the framework regions of a heavy chain variable region sequence selected from the group consisting of SEQ ID NO: 201, SEQ ID NO: 206, and SEQ ID NOS: 215 to 389. In certain embodiments, the antibody or antigen-binding fragment thereof described herein comprises a heavy chain variable framework region that is or is derived from an amino acid sequence encoded by a human gene, wherein the amino acid sequence is selected from the group consisting of IGHV1-2*02 (SEQ ID NO: 601), IGHV1-3*01 (SEQ ID NO: 602), IGHV1-46*01 (SEQ ID NO: 603), IGHV1-18*01 (SEQ ID NO: 604), IGHV1-69*01 (SEQ ID NO: 605), and IGHV7-4-1*02 (SEQ ID NO: 606). In specific embodiments, the heavy chain variable framework region that is derived from said amino acid sequence consists of said amino acid sequence but for the presence of up to 10 amino acid substitutions, deletions, and/or insertions, preferably up to 10 amino acid substitutions. In a particular embodiment, the heavy chain variable framework region that is derived from said amino acid sequence consists of said amino acid sequence with 1, 2, 3, 4, 5, 6, 7, 8, 9 or 10 amino acid residues being substituted for an amino acid found in an analogous position in a corresponding non-human heavy chain variable framework region. In specific embodiments, the antibody or antigen-binding fragment thereof described herein comprises a heavy chain variable framework region that is derived from amino acid sequence SEQ ID NO: 601, wherein at least one amino acid in amino acid sequence SEQ ID NO: 601 is substituted with an amino acid in an analogous position in a corresponding non-human light chain variable framework region. In certain embodiments, the amino acid substitution is at an amino acid position selected from the group consisting of 24, 48, 67, 71, 73, and 94, wherein the amino acid position of each group member is indicated according to the Kabat numbering. In specific embodiments, the amino acid substitution is selected from the group consisting of 24G, 48I, 67A, 71V, 73K, and 94K, wherein the amino acid position of each group member is indicated according to the Kabat numbering.

In some embodiments, the antibody or antigen-binding fragment thereof described herein comprises VL framework regions of an antibody set forth in Table 3. In certain embodiments, the antibody or antigen-binding fragment thereof described herein comprises a light chain variable region sequence comprising one, two, three or four of the framework regions of the light chain variable region sequence of SEQ ID NO: 204 or SEQ ID NO: 205. In some embodiments, the antibody or antigen-binding fragment thereof described herein comprises one, two, three or four framework regions of a light chain variable region sequence which is at least 75%, 80%, 85%, 90%, 95%, or 100% identical to one, two, three or four of the framework regions of a light chain variable region sequence selected from the group consisting of SEQ ID NO: 202, SEQ ID NO: 207, SEQ ID NO: 208, and SEQ ID NOs: 400-518. In some embodiments, the antibody or antigen-binding fragment thereof described herein comprises one, two, three or four framework regions of a light chain variable region sequence which is at least 75%, 80%, 85%, 90%, 95%, or 100% identical to one, two, three or four of the framework regions of the light chain variable region sequence of SEQ ID NO: 519. In certain embodiments, an antibody or antigen-binding fragment thereof described herein comprises a light chain variable framework region that is or is derived from an amino acid sequence encoded by a human gene, wherein the amino acid sequence is selected from the group consisting of IGKV4-1*01 (SEQ ID NO: 607) and IGKV3-7*02 (SEQ ID NO: 608). In specific embodiments, the light chain variable framework region that is derived from said amino acid sequence consists of said amino acid sequence but for the presence of up to 10 amino acid substitutions, deletions, and/or insertions, preferably up to 10 amino acid substitutions. In a particular embodiment, the light chain variable framework region that is derived from said amino acid sequence consists of said amino acid sequence with 1, 2, 3, 4, 5, 6, 7, 8, 9 or 10 amino acid residues being substituted for an amino acid found in an analogous position in a corresponding non-human light chain variable framework region. In some embodiments, an antibody or antigen-binding fragment thereof described herein comprises a light chain variable framework region that is derived from amino acid sequence SEQ ID NO: 607 or SEQ ID NO: 608, wherein at least one amino acid of amino acid sequence SEQ ID NO: 607 or SEQ ID NO: 608 with an amino acid in an analogous position in a corresponding non-human light chain variable framework region. In a specific embodiment, the amino acid substitution is at amino acid position 87, wherein the amino acid position is indicated according to the Kabat numbering. In particular embodiments, the amino acid substitution is 87H, wherein the amino acid position is indicated according to the Kabat numbering.

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of Hum231#1, for example, the VL CDR1, VL CDR2, VL CDR3, VH CDR1, VH CDR2, and VH CDR3 of Hum231#1 as set forth in Tables 1 and 2 (SEQ ID NOS: 16, 17, 18, 13, 14, and 15, respectively). In certain embodiments, the antibody or antigen-binding fragment further comprises one, two, three or all four VL framework regions derived from the VH of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of Hum231#1).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of Hum231#2, for example, the VL CDR1, VL CDR2, VL CDR3, VH CDR1, VH CDR2, and VH CDR3 of Hum231#2 as set forth in Tables 1 and 2 (SEQ ID NOS: 16, 17, 18, 13, 14, and 15, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the frameworks of a single antibody as designated by its name, for example, the framework regions of Hum231#1 or Hum231#2).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1964, for example, the VL CDR1, VL CDR2, VL CDR3, VH CDR1, VH CDR2, and VH CDR3 of pab1964 as set forth in Tables 1 and 2 (SEQ ID NOS: 101, 105, 106, 19, 24, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1964).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1965, for example, the VL CDR1, VL CDR2, VL CDR3, VH CDR1, VH CDR2, and VH CDR3 of pab1965 as set forth in Tables 1 and 2 (SEQ ID NOS: 102, 105, 107, 19, 25, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1965).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1966, for example, the VL CDR1, VL CDR2, VL CDR3, VH CDR1, VH CDR2, and VH CDR3 of pab1966 as set forth in Tables 1 and 2 (SEQ ID NOS: 102, 105, 107, 19, 26, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1966).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1967, for example, the VL CDR1, VL CDR2, VL CDR3, VH CDR1, VH CDR2, and VH CDR3 of pab1967 as set forth in Tables 1 and 2 (SEQ ID NOS: 103, 105, 108, 20, 27, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1967).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1968, for example, the VL CDR1, VL CDR2, VL CDR3, VH CDR1, VH CDR2, and VH CDR3 of pab1968 as set forth in Tables 1 and 2 (SEQ ID NOS: 101, 105, 107, 21, 28, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1968).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1969, for example, the VL CDR1, VL CDR2, VL CDR3, VH CDR1, VH CDR2, and VH CDR3 of pab1969 as set forth in Tables 1 and 2 (SEQ ID NOS: 103, 105, 109, 22, 29, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1969).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1970, for example, the VL CDR1, VL CDR2, VL CDR3, VH CDR1, VH CDR2, and VH CDR3 of pab1970 as set forth in Tables 1 and 2 (SEQ ID NOS: 101, 105, 109, 21, 24, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1970).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1971, for example, the VL CDR1, VL CDR2, VL CDR3, VH CDR1, VH CDR2, and VH CDR3 of pab1971 as set forth in Tables 1 and 2 (SEQ ID NOS: 103, 105, 107, 21, 177, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1971).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1972, for example, the VL CDR1, VL CDR2, VL CDR3, VH CDR1, VH CDR2, and VH CDR3 of pab1972 as set forth in Tables 1 and 2 (SEQ ID NOS: 104, 105, 107, 23, 31, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1972).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1973, for example, the VL CDR1, VL CDR2, VL CDR3, VH CDR1, VH CDR2, and VH CDR3 of pab1973 as set forth in Tables 1 and 2 (SEQ ID NOS: 103, 105, 107, 19, 32, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1973).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1975, for example, the VL CDR1, VL CDR2, VL CDR3, VH CDR1, VH CDR2, and VH CDR3 of pab1975 as set forth in Tables 1 and 2 (SEQ ID NOS: 102, 105, 107, 22, 29, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1975).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1976, for example, the VL CDR1, VL CDR2, VL CDR3, VH CDR1, VH CDR2, and VH CDR3 of pab1976 as set forth in Tables 1 and 2 (SEQ ID NOS: 101, 105, 107, 22, 29, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1976).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1977, for example, the VL CDR1, VL CDR2, VL CDR3, VH CDR1, VH CDR2, and VH CDR3 of pab1977 as set forth in Tables 1 and 2 (SEQ ID NOS: 103, 105, 107, 22, 29, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1977).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1979, for example, the VL CDR1, VL CDR2, VL CDR3, VH CDR1, VH CDR2, and VH CDR3 of pab1979 as set forth in Tables 1 and 2 (SEQ ID NOS: 102, 105, 107, 22, 33, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1979).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1980, for example, the VL CDR1, VL CDR2, VL CDR3, VH CDR1, VH CDR2, and VH CDR3 of pab1980 as set forth in Tables 1 and 2 (SEQ ID NOS: 101, 105, 107, 22, 33, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1980).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1981, for example, the VL CDR1, VL CDR2, VL CDR3, VH CDR1, VH CDR2, and VH CDR3 of pab1981 as set forth in Tables 1 and 2 (SEQ ID NOS: 103, 105, 107, 22, 33, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1981).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab1983, for example, the VL CDR1, VL CDR2, VL CDR3, VH CDR1, VH CDR2, and VH CDR3 of pab1983 as set forth in Tables 1 and 2 (SEQ ID NOS: 102, 105, 107, 19, 24, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab1983).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab2159, for example, the VL CDR1, VL CDR2, VL CDR3, VH CDR1, VH CDR2, and VH CDR3 of pab2159 as set forth in Tables 1 and 2 (SEQ ID NOS: 102, 105, 109, 19, 144, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab2159).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab2160, for example, the VL CDR1, VL CDR2, VL CDR3, VH CDR1, VH CDR2, and VH CDR3 of pab2160 as set forth in Tables 1 and 2 (SEQ ID NOS: 102, 105, 107, 119, 162, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab2160).

In a particular embodiment, an antibody or fragment thereof described herein, which specifically binds to GITR (e.g., human GITR), comprises the VL CDR1, VL CDR2, VL CDR3, VH CDR1, VH CDR2, and VH CDR3 of pab2161, for example, the VL CDR1, VL CDR2, VL CDR3, VH CDR1, VH CDR2, and VH CDR3 of pab2161 as set forth in Tables 1 and 2 (SEQ ID NOS: 103, 105, 109, 22, 121, and 34, respectively). In certain embodiments, the antibody or antigen-binding fragment further comprises one, two, three or all four VL framework regions derived from the VL of a human or primate antibody and one, two, three or all four VH framework regions derived from the VH of a human or primate antibody. In some embodiments, the antibody or antigen-binding fragment thereof comprises VL framework regions and VH framework regions of an antibody set forth in Tables 3 and 4, respectively (e.g., the framework regions of pab2161).

In certain embodiments, an antibody or fragment thereof that specifically binds to GITR (e.g., human GITR) comprises a VL domain comprising the amino acid sequence of a VL domain of an antibody listed in FIG. 23 or any one of FIGS. 24A-24C (e.g., the VL domain in one row of FIG. 23 or any one of FIGS. 24A-24C). In certain embodiments, an antibody or fragment thereof that specifically binds to GITR (e.g., human GITR) comprises a VL domain comprising the amino acid sequence of a VL domain of an antibody listed in Table 17 (e.g., the VL domain in one row of Table 17). In a specific embodiment, an antibody or fragment thereof that specifically binds to GITR (e.g., human GITR) comprises a VL domain comprising SEQ ID NO: 207 (e.g., antibody Hum231#1). In a specific embodiment, an antibody or fragment thereof that specifically binds to GITR (e.g., human GITR) comprises a VL domain comprising SEQ ID NO: 208 (e.g., antibody Hum231#2). In a specific embodiment, an antibody or fragment thereof that specifically binds to GITR (e.g., human GITR) comprises a VL domain comprising SEQ ID NO: 435 (e.g., antibody pab1964). In a specific embodiment, an antibody or fragment thereof that specifically binds to GITR (e.g., human GITR) comprises a VL domain comprising SEQ ID NO: 437 (e.g., antibody pab1965). In a specific embodiment, an antibody or fragment thereof that specifically binds to GITR (e.g., human GITR) comprises a VL domain comprising SEQ ID NO: 440 (e.g., antibody pab1966). In a specific embodiment, an antibody or fragment thereof that specifically binds to GITR (e.g., human GITR) comprises a VL domain comprising SEQ ID NO: 441 (e.g., antibody pab1967). In a specific embodiment, an antibody or fragment thereof that specifically binds to GITR (e.g., human GITR) comprises a VL domain comprising SEQ ID NO: 444 (e.g., antibody pab1968). In a specific embodiment, an antibody or fragment thereof that specifically binds to GITR (e.g., human GITR) comprises a VL domain comprising SEQ ID NO: 458 (e.g., antibody pab1969). In a specific embodiment, an antibody or fragment thereof that specifically binds to GITR (e.g., human GITR) comprises a VL domain comprising SEQ ID NO: 459 (e.g., antibody pab1970). In a specific embodiment, an antibody or fragment thereof that specifically binds to GITR (e.g., human GITR) comprises a VL domain comprising SEQ ID NO: 453 (e.g., antibody pab1971). In a specific embodiment, an antibody or fragment thereof that specifically binds to GITR (e.g., human GITR) comprises a VL domain comprising SEQ ID NO: 463 (e.g., antibody pab1972). In a specific embodiment, an antibody or fragment thereof that specifically binds to GITR (e.g., human GITR) comprises a VL domain comprising SEQ ID NO: 519 (e.g., antibody pab1973). In a specific embodiment, an antibody or fragment thereof that specifically binds to GITR (e.g., human GITR) comprises a VL domain comprising SEQ ID NO: 440 (e.g., antibody pab1975). In a specific embodiment, an antibody or fragment thereof that specifically binds to GITR (e.g., human GITR) comprises a VL domain comprising SEQ ID NO: 444 (e.g., antibody pab1976). In a specific embodiment, an antibody or fragment thereof that specifically binds to GITR (e.g., human GITR) comprises a VL domain comprising SEQ ID NO: 453 (e.g., antibody pab1977). In a specific embodiment, an antibody or fragment thereof that specifically binds to GITR (e.g., human GITR) comprises a VL domain comprising SEQ ID NO: 440 (e.g., antibody pab1979). In a specific embodiment, an antibody or fragment thereof that specifically binds to GITR (e.g., human GITR) comprises a VL domain comprising SEQ ID NO: 444 (e.g., antibody pab1980). In a specific embodiment, an antibody or fragment thereof that specifically binds to GITR (e.g., human GITR) comprises a VL domain comprising SEQ ID NO: 453 (e.g., antibody pab1981). In a specific embodiment, an antibody or fragment thereof that specifically binds to GITR (e.g., human GITR) comprises a VL domain comprising SEQ ID NO: 440 (e.g., antibody pab1983). In a specific embodiment, an antibody or fragment thereof that specifically binds to GITR (e.g., human GITR) comprises a VL domain comprising SEQ ID NO: 408 (e.g., antibody pab2159). In a specific embodiment, an antibody or fragment thereof that specifically binds to GITR (e.g., human GITR) comprises a VL domain comprising SEQ ID NO: 423 (e.g., antibody pab2160). In a specific embodiment, an antibody or fragment thereof that specifically binds to GITR (e.g., human GITR) comprises a VL domain comprising SEQ ID NO: 486 (e.g., antibody pab2161).

In some embodiments, an antibody or fragment thereof that specifically binds to GITR (e.g., human GITR) comprises a VL domain consisting of or consisting essentially of the amino acid sequence of a VL domain of an antibody listed in FIG. 23 or any one of FIGS. 24A-24C (e.g., the VL domain in one row of FIG. 23 or any one of FIGS. 24A-24C). In some embodiments, an antibody or fragment thereof that specifically binds to GITR (e.g., human GITR) comprises a VL domain consisting of or consisting essentially of the amino acid sequence of a VL domain of an antibody listed in Table 17 (e.g., the VL domain in one row of Table 17). In a specific embodiment, an antibody or fragment thereof that specifically binds to GITR (e.g., human GITR) comprises a VL domain consisting of or consisting essentially of SEQ ID NO: 207 (e.g., antibody Hum231#1). In a specific embodiment, an antibody or fragment thereof that specifically binds to GITR (e.g., human GITR) comprises a VL domain consisting of or consisting essentially of SEQ ID NO: 208 (e.g., antibody Hum231#2). In a specific embodiment, an antibody or fragment thereof that specifically binds to GITR (e.g., human GITR) comprises a VL domain consisting of or consisting essentially of SEQ ID NO: 435 (e.g., antibody pab1964). In a specific embodiment, an antibody or fragment thereof that specifically binds to GITR (e.g., human GITR) comprises a VL domain consisting of or consisting essentially of SEQ ID NO: 437 (e.g., antibody pab1965). In a specific embodiment, an antibody or fragment thereof that specifically binds to GITR (e.g., human GITR) comprises a VL domain consisting of or consisting essentially of SEQ ID NO: 440 (e.g., antibody pab1966). In a specific embodiment, an antibody or fragment thereof that specifically binds to GITR (e.g., human GITR) comprises a VL domain consisting of or consisting essentially of SEQ ID NO: 441 (e.g., antibody pab1967). In a specific embodiment, an antibody or fragment thereof that specifically binds to GITR (e.g., human GITR) comprises a VL domain consisting of or consisting essentially of SEQ ID NO: 444 (e.g., antibody pab1968). In a specific embodiment, an antibody or fragment thereof that specifically binds to GITR (e.g., human GITR) comprises a VL domain comprising SEQ ID NO: 458 (e.g., antibody pab1969). In a specific embodiment, an antibody or fragment thereof that specifically binds to GITR (e.g., human GITR) comprises a VL domain consisting of or consisting essentially of SEQ ID NO: 459 (e.g., antibody pab1970). In a specific embodiment, an antibody or fragment thereof that specifically binds to GITR (e.g., human GITR) comprises a VL domain consisting of or consisting essentially of SEQ ID NO: 453 (e.g., antibody pab1971). In a specific embodiment, an antibody or fragment thereof that specifically binds to GITR (e.g., human GITR) comprises a VL domain consisting of or consisting essentially of SEQ ID NO: 463 (e.g., antibody pab1972). In a specific embodiment, an antibody or fragment thereof that specifically binds to GITR (e.g., human GITR) comprises a VL domain consisting of or consisting essentially of SEQ ID NO: 519 (e.g., antibody pab1973). In a specific embodiment, an antibody or fragment thereof that specifically binds to GITR (e.g., human GITR) comprises a VL domain consisting of or consisting essentially of SEQ ID NO: 440 (e.g., antibody pab1975). In a specific embodiment, an antibody or fragment thereof that specifically binds to GITR (e.g., human GITR) comprises a VL domain consisting of or consisting essentially of SEQ ID NO: 444 (e.g., antibody pab1976). In a specific embodiment, an antibody or fragment thereof that specifically binds to GITR (e.g., human GITR) comprises a VL domain consisting of or consisting essentially of SEQ ID NO: 453 (e.g., antibody pab1977). In a specific embodiment, an antibody or fragment thereof that specifically binds to GITR (e.g., human GITR) comprises a VL domain consisting of or consisting essentially of SEQ ID NO: 440 (e.g., antibody pab1979). In a specific embodiment, an antibody or fragment thereof that specifically binds to GITR (e.g., human GITR) comprises a VL domain consisting of or consisting essentially of SEQ ID NO: 444 (e.g., antibody pab1980). In a specific embodiment, an antibody or fragment thereof that specifically binds to GITR (e.g., human GITR) comprises a VL domain consisting of or consisting essentially of SEQ ID NO: 453 (e.g., antibody pab1981). In a specific embodiment, an antibody or fragment thereof that specifically binds to GITR (e.g., human GITR) comprises a VL domain consisting of or consisting essentially of SEQ ID NO: 440 (e.g., antibody pab1983).

In a specific embodiment, an antibody or fragment thereof that specifically binds to GITR (e.g., human GITR) comprises a VL domain consisting of or consisting essentially of SEQ ID NO: 408 (e.g., antibody pab2159). In a specific embodiment, an antibody or fragment thereof that specifically binds to GITR (e.g., human GITR) comprises a VL domain consisting of or consisting essentially of SEQ ID NO: 423 (e.g., antibody pab2160). In a specific embodiment, an antibody or fragment thereof that specifically binds to GITR (e.g., human GITR) comprises a VL domain consisting of or consisting essentially of SEQ ID NO: 486 (e.g., antibody pab2161).

In certain embodiments, an antibody or fragment thereof that specifically binds to GITR (e.g., human GITR) comprises a VH domain comprising the amino acid sequence of a VH domain of an antibody listed in FIG. 23 or any one of FIGS. 24A-24C (e.g., the VH domain in one row in FIG. 23 or any one of FIGS. 24A-24C). In certain embodiments, an antibody or fragment thereof that specifically binds to GITR (e.g., human GITR) comprises a VH domain comprising the amino acid sequence of a VH domain of an antibody listed in Table 17 (e.g., the VH domain in one row in Table 17). In a specific embodiment, an antibody or fragment thereof that specifically binds to GITR (e.g., human GITR) comprises a VH domain comprising SEQ ID NO: 206 (e.g., antibody Hum231#1). In a specific embodiment, an antibody or fragment thereof that specifically binds to GITR (e.g., human GITR) comprises a VH domain comprising SEQ ID NO: 206 (e.g., antibody Hum231#2). In a specific embodiment, an antibody or fragment thereof that specifically binds to GITR (e.g., human GITR) comprises a VH domain comprising SEQ ID NO: 249 (e.g., antibody pab1964). In a specific embodiment, an antibody or fragment thereof that specifically binds to GITR (e.g., human GITR) comprises a VH domain comprising SEQ ID NO: 251 (e.g., antibody pab1965). In a specific embodiment, an antibody or fragment thereof that specifically binds to GITR (e.g., human GITR) comprises a VH domain comprising SEQ ID NO: 254 (e.g., antibody pab1966). In a specific embodiment, an antibody or fragment thereof that specifically binds to GITR (e.g., human GITR) comprises a VH domain comprising SEQ ID NO: 255 (e.g., antibody pab1967). In a specific embodiment, an antibody or fragment thereof that specifically binds to GITR (e.g., human GITR) comprises a VH domain comprising SEQ ID NO: 259 (e.g., antibody pab1968). In a specific embodiment, an antibody or fragment thereof that specifically binds to GITR (e.g., human GITR) comprises a VH domain comprising SEQ ID NO: 276 (e.g., antibody pab1969). In a specific embodiment, an antibody or fragment thereof that specifically binds to GITR (e.g., human GITR) comprises a VH domain comprising SEQ ID NO: 277 (e.g., antibody pab1970). In a specific embodiment, an antibody or fragment thereof that specifically binds to GITR (e.g., human GITR) comprises a VH domain comprising SEQ ID NO: 280 (e.g., antibody pab1971). In a specific embodiment, an antibody or fragment thereof that specifically binds to GITR (e.g., human GITR) comprises a VH domain comprising SEQ ID NO: 284 (e.g., antibody pab1972). In a specific embodiment, an antibody or fragment thereof that specifically binds to GITR (e.g., human GITR) comprises a VH domain comprising SEQ ID NO: 304 (e.g., antibody pab1973). In a specific embodiment, an antibody or fragment thereof that specifically binds to GITR (e.g., human GITR) comprises a VH domain comprising SEQ ID NO: 276 (e.g., antibody pab1975). In a specific embodiment, an antibody or fragment thereof that specifically binds to GITR (e.g., human GITR) comprises a VH domain comprising SEQ ID NO: 276 (e.g., antibody pab1976). In a specific embodiment, an antibody or fragment thereof that specifically binds to GITR (e.g., human GITR) comprises a VH domain comprising SEQ ID NO: 276 (e.g., antibody pab1977). In a specific embodiment, an antibody or fragment thereof that specifically binds to GITR (e.g., human GITR) comprises a VH domain comprising SEQ ID NO: 345 (e.g., antibody pab1979). In a specific embodiment, an antibody or fragment thereof that specifically binds to GITR (e.g., human GITR) comprises a VH domain comprising SEQ ID NO: 345 (e.g., antibody pab1980). In a specific embodiment, an antibody or fragment thereof that specifically binds to GITR (e.g., human GITR) comprises a VH domain comprising SEQ ID NO: 345 (e.g., antibody pab1981). In a specific embodiment, an antibody or fragment thereof that specifically binds to GITR (e.g., human GITR) comprises a VH domain comprising SEQ ID NO: 249 (e.g., antibody pab1983). In a specific embodiment, an antibody or fragment thereof that specifically binds to GITR (e.g., human GITR) comprises a VH domain comprising SEQ ID NO: 224 (e.g., antibody pab2159). In a specific embodiment, an antibody or fragment thereof that specifically binds to GITR (e.g., human GITR) comprises a VH domain comprising SEQ ID NO: 237 (e.g., antibody pab2160). In a specific embodiment, an antibody or fragment thereof that specifically binds to GITR (e.g., human GITR) comprises a VH domain comprising SEQ ID NO: 315 (e.g., antibody pab2161).

In some embodiments, an antibody or fragment thereof that specifically binds to GITR (e.g., human GITR) comprises a VH domain consisting of or consisting essentially of the amino acid sequence of a VH domain of an antibody listed in FIG. 23 or any one of FIGS. 24A-24C (e.g., the VH domain in one row in FIG. 23 or any one of FIGS. 24A-24C). In some embodiments, an antibody or fragment thereof that specifically binds to GITR (e.g., human GITR) comprises a VH domain consisting of or consisting essentially of the amino acid sequence of a VH domain of an antibody listed in Table 17 (e.g., the VH domain in one row in Table 17). In a specific embodiment, an antibody or fragment thereof that specifically binds to GITR (e.g., human GITR) comprises a VH domain consisting of or consisting essentially of SEQ ID NO: 206 (e.g., antibody Hum231#1). In a specific embodiment, an antibody or fragment thereof that specifically binds to GITR (e.g., human GITR) comprises a VH domain consisting of or consisting essentially of SEQ ID NO: 206 (e.g., antibody Hum231#2). In a specific embodiment, an antibody or fragment thereof that specifically binds to GITR (e.g., human GITR) comprises a VH domain consisting of or consisting essentially of SEQ ID NO: 249 (e.g., antibody pab1964). In a specific embodiment, an antibody or fragment thereof that specifically binds to GITR (e.g., human GITR) comprises a VH domain consisting of or consisting essentially of SEQ ID NO: 251 (e.g., antibody pab1965). In a specific embodiment, an antibody or fragment thereof that specifically binds to GITR (e.g., human GITR) comprises a VH domain consisting of or consisting essentially of SEQ ID NO: 254 (e.g., antibody pab1966). In a specific embodiment, an antibody or fragment thereof that specifically binds to GITR (e.g., human GITR) comprises a VH domain consisting of or consisting essentially of SEQ ID NO: 255 (e.g., antibody pab1967). In a specific embodiment, an antibody or fragment thereof that specifically binds to GITR (e.g., human GITR) comprises a VH domain consisting of or consisting essentially of SEQ ID NO: 259 (e.g., antibody pab1968). In a specific embodiment, an antibody or fragment thereof that specifically binds to GITR (e.g., human GITR) comprises a VH domain consisting of or consisting essentially of SEQ ID NO: 276 (e.g., antibody pab1969). In a specific embodiment, an antibody or fragment thereof that specifically binds to GITR (e.g., human GITR) comprises a VH domain consisting of or consisting essentially of SEQ ID NO: 277 (e.g., antibody pab1970). In a specific embodiment, an antibody or fragment thereof that specifically binds to GITR (e.g., human GITR) comprises a VH domain consisting of or consisting essentially of SEQ ID NO: 280 (e.g., antibody pab1971). In a specific embodiment, an antibody or fragment thereof that specifically binds to GITR (e.g., human GITR) comprises a VH domain consisting of or consisting essentially of SEQ ID NO: 284 (e.g., antibody pab1972). In a specific embodiment, an antibody or fragment thereof that specifically binds to GITR (e.g., human GITR) comprises a VH domain consisting of or consisting essentially of SEQ ID NO: 304 (e.g., antibody pab1973). In a specific embodiment, an antibody or fragment thereof that specifically binds to GITR (e.g., human GITR) comprises a VH domain consisting of or consisting essentially of SEQ ID NO: 276 (e.g., antibody pab1975). In a specific embodiment, an antibody or fragment thereof that specifically binds to GITR (e.g., human GITR) comprises a VH domain consisting of or consisting essentially of SEQ ID NO: 276 (e.g., antibody pab1976). In a specific embodiment, an antibody or fragment thereof that specifically binds to GITR (e.g., human GITR) comprises a VH domain consisting of or consisting essentially of SEQ ID NO: 276 (e.g., antibody pab1977). In a specific embodiment, an antibody or fragment thereof that specifically binds to GITR (e.g., human GITR) comprises a VH domain consisting of or consisting essentially of SEQ ID NO: 345 (e.g., antibody pab1979). In a specific embodiment, an antibody or fragment thereof that specifically binds to GITR (e.g., human GITR) comprises a VH domain consisting of or consisting essentially of SEQ ID NO: 345 (e.g., antibody pab1980). In a specific embodiment, an antibody or fragment thereof that specifically binds to GITR (e.g., human GITR) comprises a VH domain consisting of or consisting essentially of SEQ ID NO: 345 (e.g., antibody pab1981). In a specific embodiment, an antibody or fragment thereof that specifically binds to GITR (e.g., human GITR) comprises a VH domain consisting of or consisting essentially of SEQ ID NO: 249 (e.g., antibody pab1983). In a specific embodiment, an antibody or fragment thereof that specifically binds to GITR (e.g., human GITR) comprises a VH domain consisting of or consisting essentially of SEQ ID NO: 224 (e.g., antibody pab2159). In a specific embodiment, an antibody or fragment thereof that specifically binds to GITR (e.g., human GITR) comprises a VH domain consisting of or consisting essentially of SEQ ID NO: 237 (e.g., antibody pab2160). In a specific embodiment, an antibody or fragment thereof that specifically binds to GITR (e.g., human GITR) comprises a VH domain consisting of or consisting essentially of SEQ ID NO: 315 (e.g., antibody pab2161).

In certain embodiments, an antibody or fragment thereof that specifically binds to GITR (e.g., human GITR) comprises a VH domain and a VL domain, wherein the VH domain and the VL domain comprise the amino acid sequence of a VH domain and a VL domain of an antibody listed in FIG. 23 or any one of FIGS. 24A-24C (e.g., the VH domain and VL domain in one row of FIG. 23 or any one of FIGS. 24A-24C). In certain embodiments, an antibody or fragment thereof that specifically binds to GITR (e.g., human GITR) comprises a VH domain and a VL domain, wherein the VH domain and the VL domain comprise the amino acid sequence of a VH domain and a VL domain of an antibody listed in Table 17 (e.g., the VH domain and VL domain in one row of Table 17). In a specific embodiment, an antibody or fragment thereof that specifically binds to GITR (e.g., human GITR) comprises a VL domain comprising SEQ ID NO: 207 and a VH domain comprising SEQ ID NO: 206 (e.g., antibody Hum231#1). In a specific embodiment, an antibody or fragment thereof that specifically binds to GITR (e.g., human GITR) comprises a VL domain comprising SEQ ID NO: 208 and a VH domain comprising SEQ ID NO: 206 (e.g., antibody Hum231#2). In a specific embodiment, an antibody or fragment thereof that specifically binds to GITR (e.g., human GITR) comprises a VL domain comprising SEQ ID NO: 435 and a VH domain comprising SEQ ID NO: 249 (e.g., antibody pab1964). In a specific embodiment, an antibody or fragment thereof that specifically binds to GITR (e.g., human GITR) comprises a VL domain comprising SEQ ID NO: 437 and a VH domain comprising SEQ ID NO: 251 (e.g., antibody pab1965). In a specific embodiment, an antibody or fragment thereof that specifically binds to GITR (e.g., human GITR) comprises a VL domain comprising SEQ ID NO: 440 and a VH domain comprising SEQ ID NO: 254 (e.g., antibody pab1966). In a specific embodiment, an antibody or fragment thereof that specifically binds to GITR (e.g., human GITR) comprises a VL domain comprising SEQ ID NO: 441 and a VH domain comprising SEQ ID NO: 255 (e.g., antibody pab1967). In a specific embodiment, an antibody or fragment thereof that specifically binds to GITR (e.g., human GITR) comprises a VL domain comprising SEQ ID NO: 444 and a VH domain comprising SEQ ID NO: 259 (e.g., antibody pab1968). In a specific embodiment, an antibody or fragment thereof that specifically binds to GITR (e.g., human GITR) comprises a VL domain comprising SEQ ID NO: 458 and a VH domain comprising SEQ ID NO: 276 (e.g., antibody pab1969). In a specific embodiment, an antibody or fragment thereof that specifically binds to GITR (e.g., human GITR) comprises a VL domain comprising SEQ ID NO: 459 and a VH domain comprising SEQ ID NO: 277 (e.g., antibody pab1970). In a specific embodiment, an antibody or fragment thereof that specifically binds to GITR (e.g., human GITR) comprises a VL domain comprising SEQ ID NO: 453 and a VH domain comprising SEQ ID NO: 280 (e.g., antibody pab1971). In a specific embodiment, an antibody or fragment thereof that specifically binds to GITR (e.g., human GITR) comprises a VL domain comprising SEQ ID NO: 463 and a VH domain comprising SEQ ID NO: 284 (e.g., antibody pab1972). In a specific embodiment, an antibody or fragment thereof that specifically binds to GITR (e.g., human GITR) comprises a VL domain comprising SEQ ID NO: 519 and a VH domain comprising SEQ ID NO: 304 (e.g., antibody pab1973). In a specific embodiment, an antibody or fragment thereof that specifically binds to GITR (e.g., human GITR) comprises a VL domain comprising SEQ ID NO: 440 and a VH domain comprising SEQ ID NO: 276 (e.g., antibody pab1975). In a specific embodiment, an antibody or fragment thereof that specifically binds to GITR (e.g., human GITR) comprises a VL domain comprising SEQ ID NO: 444 and a VH domain comprising SEQ ID NO: 276 (e.g., antibody pab1976). In a specific embodiment, an antibody or fragment thereof that specifically binds to GITR (e.g., human GITR) comprises a VL domain comprising SEQ ID NO: 453 and a VH domain comprising SEQ ID NO: 276 (e.g., antibody pab1977). In a specific embodiment, an antibody or fragment thereof that specifically binds to GITR (e.g., human GITR) comprises a VL domain comprising SEQ ID NO: 440 and a VH domain comprising SEQ ID NO: 345 (e.g., antibody pab1979). In a specific embodiment, an antibody or fragment thereof that specifically binds to GITR (e.g., human GITR) comprises a VL domain comprising SEQ ID NO: 444 and a VH domain comprising SEQ ID NO: 345 (e.g., antibody pab1980). In a specific embodiment, an antibody or fragment thereof that specifically binds to GITR (e.g., human GITR) comprises a VL domain comprising SEQ ID NO: 453 and a VH domain comprising SEQ ID NO: 345 (e.g., antibody pab1981). In a specific embodiment, an antibody or fragment thereof that specifically binds to GITR (e.g., human GITR) comprises a VL domain comprising SEQ ID NO: 440 and a VH domain comprising SEQ ID NO: 249 (e.g., antibody pab1983). In a specific embodiment, an antibody or fragment thereof that specifically binds to GITR (e.g., human GITR) comprises a VL domain comprising SEQ ID NO: 408 and a VH domain comprising SEQ ID NO: 224 (e.g., antibody pab2159). In a specific embodiment, an antibody or fragment thereof that specifically binds to GITR (e.g., human GITR) comprises a VL domain comprising SEQ ID NO: 423 and a VH domain comprising SEQ ID NO: 237 (e.g., antibody pab2160). In a specific embodiment, an antibody or fragment thereof that specifically binds to GITR (e.g., human GITR) comprises a VL domain comprising SEQ ID NO: 486 and a VH domain comprising SEQ ID NO: 315 (e.g., antibody pab2161).

In certain embodiments, an antibody or fragment thereof that specifically binds to GITR (e.g., human GITR) comprises a VH domain and a VL domain, wherein the VH domain and the VL domain consist of or consist essentially of the amino acid sequence of a VH domain and a VL domain of an antibody listed in FIG. 23 or any one of FIGS. 24A-24C (e.g., the VH domain and VL domain in one row of FIG. 23 or any one of FIGS. 24A-24C). In certain embodiments, an antibody or fragment thereof that specifically binds to GITR (e.g., human GITR) comprises a VH domain and a VL domain, wherein the VH domain and the VL domain consist of or consist essentially of the amino acid sequence of a VH domain and a VL domain of an antibody listed in Table 17 (e.g., the VH domain and VL domain in one row of Table 17). In a specific embodiment, an antibody or fragment thereof that specifically binds to GITR (e.g., human GITR) comprises a VL domain and a VH domain, wherein the VL domain consists of or consists essentially of SEQ ID NO: 207 and the VH domain consisting of or consisting essentially of SEQ ID NO: 206 (e.g., antibody Hum231#1). In a specific embodiment, an antibody or fragment thereof that specifically binds to GITR (e.g., human GITR) comprises a VL domain and a VH domain, wherein the VL domain consists of or consists essentially of SEQ ID NO: 208 and the VH domain consists of or consists essentially of SEQ ID NO: 206 (e.g., antibody Hum231#2). In a specific embodiment, an antibody or fragment thereof that specifically binds to GITR (e.g., human GITR) comprises a VL domain and a VH domain, wherein the VL domain consists of or consists essentially of SEQ ID NO: 435 and the VH domain consists of or consists essentially of SEQ ID NO: 249 (e.g., antibody pab1964). In a specific embodiment, an antibody or fragment thereof that specifically binds to GITR (e.g., human GITR) comprises a VL domain and a VH domain, wherein the VL domain consists of or consists essentially of SEQ ID NO: 437 and the VH domain consists of or consists essentially of SEQ ID NO: 251 (e.g., antibody pab1965). In a specific embodiment, an antibody or fragment thereof that specifically binds to GITR (e.g., human GITR) comprises a VL domain and a VH domain, wherein the VL domain consists of or consists essentially of SEQ ID NO: 440 and the VH domain consists of or consists essentially of SEQ ID NO: 254 (e.g., antibody pab1966). In a specific embodiment, an antibody or fragment thereof that specifically binds to GITR (e.g., human GITR) comprises a VL domain and a VH domain, wherein the VL domain consists of or consists essentially of SEQ ID NO: 441 and the VH domain consists of or consists essentially of SEQ ID NO: 255 (e.g., antibody pab1967). In a specific embodiment, an antibody or fragment thereof that specifically binds to GITR (e.g., human GITR) comprises a VL domain and a VH domain, wherein the VL domain consists of or consists essentially of SEQ ID NO: 444 and the VH domain consists of or consists essentially of SEQ ID NO: 259 (e.g., antibody pab1968). In a specific embodiment, an antibody or fragment thereof that specifically binds to GITR (e.g., human GITR) comprises a VL domain and a VH domain, wherein the VL domain consists of or consists essentially of SEQ ID NO: 458 and the VH domain consists of or consists essentially of SEQ ID NO: 276 (e.g., antibody pab1969). In a specific embodiment, an antibody or fragment thereof that specifically binds to GITR (e.g., human GITR) comprises a VL domain and a VH domain, wherein the VL domain consists of or consists essentially of SEQ ID NO: 459 and the VH domain consists of or consists essentially of SEQ ID NO: 277 (e.g., antibody pab1970). In a specific embodiment, an antibody or fragment thereof that specifically binds to GITR (e.g., human GITR) comprises a VL domain and a VH domain, wherein the VL domain consists of or consists essentially of SEQ ID NO: 453 and the VH domain consists of or consists essentially of SEQ ID NO: 280 (e.g., antibody pab1971). In a specific embodiment, an antibody or fragment thereof that specifically binds to GITR (e.g., human GITR) comprises a VL domain and a VH domain, wherein the VL domain consists of or consists essentially of SEQ ID NO: 463 and the VH domain consists of or consists essentially of SEQ ID NO: 284 (e.g., antibody pab1972). In a specific embodiment, an antibody or fragment thereof that specifically binds to GITR (e.g., human GITR) comprises a VL domain and a VH domain, wherein the VL domain consists of or consists essentially of SEQ ID NO: 519 and the VH domain consists of or consists essentially of SEQ ID NO: 304 (e.g., antibody pab1973). In a specific embodiment, an antibody or fragment thereof that specifically binds to GITR (e.g., human GITR) comprises a VL domain and a VH domain, wherein the VL domain consists of or consists essentially of SEQ ID NO: 440 and the VH domain consists of or consists essentially of SEQ ID NO: 276 (e.g., antibody pab1975). In a specific embodiment, an antibody or fragment thereof that specifically binds to GITR (e.g., human GITR) comprises a VL domain and a VH domain, wherein the VL domain consists of or consists essentially of SEQ ID NO: 444 and the VH domain consists of or consists essentially of SEQ ID NO: 276 (e.g., antibody pab1976). In a specific embodiment, an antibody or fragment thereof that specifically binds to GITR (e.g., human GITR) comprises a VL domain and a VH domain, wherein the VL domain consists of or consists essentially of SEQ ID NO: 453 and the VH domain consists of or consists essentially of SEQ ID NO: 276 (e.g., antibody pab1977). In a specific embodiment, an antibody or fragment thereof that specifically binds to GITR (e.g., human GITR) comprises a VL domain and a VH domain, wherein the VL domain consists of or consists essentially of SEQ ID NO: 440 and the VH domain consists of or consists essentially of SEQ ID NO: 345 (e.g., antibody pab1979). In a specific embodiment, an antibody or fragment thereof that specifically binds to GITR (e.g., human GITR) comprises a VL domain and a VH domain, wherein the VL domain consists of or consists essentially of SEQ ID NO: 444 and the VH domain consists of or consists essentially of SEQ ID NO: 345 (e.g., antibody pab1980). In a specific embodiment, an antibody or fragment thereof that specifically binds to GITR (e.g., human GITR) comprises a VL domain and a VH domain, wherein the VL domain consists of or consists essentially of SEQ ID NO: 453 and the VH domain consists of or consists essentially of SEQ ID NO: 345 (e.g., antibody pab1981). In a specific embodiment, an antibody or fragment thereof that specifically binds to GITR (e.g., human GITR) comprises a VL domain and a VH domain, wherein the VL domain consists of or consists essentially of SEQ ID NO: 440 and the VH domain consists of or consists essentially of SEQ ID NO: 249 (e.g., antibody pab1983). In a specific embodiment, an antibody or fragment thereof that specifically binds to GITR (e.g., human GITR) comprises a VL domain and a VH domain, wherein the VL domain consists of or consists essentially of SEQ ID NO: 408 and the VH domain consists of or consists essentially of SEQ ID NO: 224 (e.g., antibody pab2159). In a specific embodiment, an antibody or fragment thereof that specifically binds to GITR (e.g., human GITR) comprises a VL domain and a VH domain, wherein the VL domain consists of or consists essentially of SEQ ID NO: 423 and the VH domain consists of or consists essentially of SEQ ID NO: 237 (e.g., antibody pab2160). In a specific embodiment, an antibody or fragment thereof that specifically binds to GITR (e.g., human GITR) comprises a VL domain and a VH domain, wherein the VL domain consists of or consists essentially of SEQ ID NO: 486 and the VH domain consists of or consists essentially of SEQ ID NO: 315 (e.g., antibody pab2161).

In certain aspects, an antibody described herein may be described by its VL domain alone, or its VH domain alone, or by its 3 VL CDRs alone, or its 3 VH CDRs alone. See, for example, Rader C et al., (1998) PNAS 95: 8910-8915, which is incorporated herein by reference in its entirety, describing the humanization of the mouse anti-αvβ3 antibody by identifying a complementing light chain or heavy chain, respectively, from a human light chain or heavy chain library, resulting in humanized antibody variants having affinities as high or higher than the affinity of the original antibody. See also, Clackson T et al., (1991) Nature 352: 624-628, which is incorporated herein by reference in its entirety, describing methods of producing antibodies that bind a specific antigen by using a specific VL domain (or VH domain) and screening a library for the complementary variable domains. The screen produced 14 new partners for a specific VH domain and 13 new partners for a specific VL domain, which were strong binders, as determined by ELISA. See also, Kim S J & Hong H J, (2007) J Microbiol 45: 572-577, which is incorporated herein by reference in its entirety, describing methods of producing antibodies that bind a specific antigen by using a specific VH domain and screening a library (e.g., human VL library) for complementary VL domains; the selected VL domains in turn could be used to guide selection of additional complementary (e.g., human) VH domains.

In certain aspects, the CDRs of an antibody can be determined according to the Chothia numbering scheme, which refers to the location of immunoglobulin structural loops (see, e.g., Chothia C & Lesk A M, (1987), J Mol Biol 196: 901-917; Al-Lazikani B et al., (1997) J Mol Biol 273: 927-948; Chothia C et al., (1992) J Mol Biol 227: 799-817; Tramontano A et al., (1990) J Mol Biol 215(1): 175-82; and U.S. Pat. No. 7,709,226). Typically, when using the Kabat numbering convention, the Chothia CDR-H1 loop is present at heavy chain amino acids 26 to 32, 33, or 34, the Chothia CDR-H2 loop is present at heavy chain amino acids 52 to 56, and the Chothia CDR-H3 loop is present at heavy chain amino acids 95 to 102, while the Chothia CDR-L1 loop is present at light chain amino acids 24 to 34, the Chothia CDR-L2 loop is present at light chain amino acids 50 to 56, and the Chothia CDR-L3 loop is present at light chain amino acids 89 to 97. The end of the Chothia CDR-HI loop when numbered using the Kabat numbering convention varies between H32 and H34 depending on the length of the loop (this is because the Kabat numbering scheme places the insertions at H35A and H35B; if neither 35A nor 35B is present, the loop ends at 32; if only 35A is present, the loop ends at 33; if both 35A and 35B are present, the loop ends at 34).

In certain aspects, provided herein are antibodies or fragments thereof that specifically bind to GITR (e.g., human GITR) and comprise one or more Chothia VL CDRs of a VL of any one of the antibodies described herein, (e.g., any one of Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161) and/or one or more Chothia VH CDRs of a VH of any one of the antibodies described herein (e.g., any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161,). In certain embodiments, antibodies or fragments thereof that specifically bind to GITR (e.g., human GITR) comprise one or more CDRs, in which the Chothia and Kabat CDRs have the same amino acid sequence. In certain embodiments, provided herein are antibodies or fragments thereof that specifically bind to GITR (e.g., human GITR) and comprise combinations of Kabat CDRs and Chothia CDRs. In a particular embodiment, provided herein are antibodies or fragments thereof that specifically bind to GITR (e.g., human GITR) and comprise Chothia CDRs of any of the antibodies described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161).

In certain aspects, the CDRs of an antibody can be determined according to the IMGT numbering system as described in Lefranc M-P, (1999) The Immunologist 7: 132-136 and Lefranc M-P et al., (1999) Nucleic Acids Res 27: 209-212. According to the IMGT numbering scheme, VH-CDR1 is at positions 26 to 35, VH-CDR2 is at positions 51 to 57, VH-CDR3 is at positions 93 to 102, VL-CDR1 is at positions 27 to 32, VL-CDR2 is at positions 50 to 52, and VL-CDR3 is at positions 89 to 97. In a particular embodiment, provided herein are antibodies or fragments thereof that specifically bind to GITR (e.g., human GITR) and comprise CDRs of any one of the antibodies described herein (e.g., any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), which are determined by the IMGT numbering system, for example, as described in Lefranc M-P (1999) supra and Lefranc M-P et al., (1999) supra).

In certain aspects, the CDRs of an antibody can be determined according to MacCallum R M et al., (1996) J Mol Biol 262: 732-745. See also, e.g., Martin A. "Protein Sequence and Structure Analysis of Antibody Variable Domains," in *Antibody Engineering*, Kontermann and Dübel, eds., Chapter 31, pp. 422-439, Springer-Verlag, Berlin (2001). In a particular embodiment, provided herein are antibodies or fragments thereof that specifically bind to GITR (e.g., human GITR) and comprise CDRs of any one of the antibodies described herein (e.g., any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), which are determined by the method in MacCallum R M et al.

In certain aspects, the CDRs of an antibody can be determined according to the AbM numbering scheme, which refers AbM hypervariable regions which represent a compromise between the Kabat CDRs and Chothia structural loops, and are used by Oxford Molecular's AbM antibody modeling software (Oxford Molecular Group, Inc.). In a particular embodiment, provided herein are antibodies or fragments thereof that specifically bind to GITR (e.g., human GITR) and comprise CDRs of any one of the antibodies described herein (e.g., any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161,), which are determined by the AbM numbering scheme.

In a specific embodiment, the position of one or more CDRs along the VH (e.g., CDR1, CDR2, or CDR3) and/or VL (e.g., CDR1, CDR2, or CDR3) region of an antibody described herein may vary by one, two, three, four, five, or six amino acid positions so long as immunospecific binding to GITR (e.g., human GITR) is maintained (e.g., substantially maintained, for example, at least 50%, at least 60%, at least 70%, at least 80%, at least 90%, at least 95%). For example, in one embodiment, the position defining a CDR of any of antibody described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161) may vary by shifting the N-terminal and/or C-terminal boundary of the CDR by one, two, three, four, five, or six amino acids, relative to the CDR position of any one of the antibodies described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161, identified in, e.g., Table 1), so long as immunospecific binding to GITR (e.g., human GITR) is maintained (e.g., substantially maintained, for example, at least 50%, at least 60%, at least 70%, at least 80%, at least 90%, at least 95%). In another embodiment, the length of one or more CDRs along the VH (e.g., CDR1, CDR2, or CDR3) and/or VL (e.g., CDR1, CDR2, or CDR3) region of an antibody described herein may vary (e.g., be shorter or longer) by one, two, three, four, five, or more amino acids, so long as immunospecific binding to GITR (e.g., human GITR) is maintained (e.g., substantially maintained, for example, at least 50%, at least 60%, at least 70%, at least 80%, at least 90%, at least 95%).

In one embodiment, a VL CDR1, VL CDR2, VL CDR3, VH CDR1, VH CDR2, and/or VH CDR3 described herein may be one, two, three, four, five or more amino acids shorter than one or more of the CDRs described herein (e.g., SEQ ID NO: 1-34, 101-109, or 114-189 or SEQ ID NO: 35 or 191-194) so long as immunospecific binding to GITR (e.g., human GITR) is maintained (e.g., substantially maintained, for example, at least 50%, at least 60%, at least 70%, at least 80%, at least 90%, at least 95%). In another embodiment, a VL CDR1, VL CDR2, VL CDR3, VH CDR1, VH CDR2, and/or VH CDR3 described herein may be one, two, three, four, five or more amino acids longer than one or more of the CDRs described herein (e.g., SEQ ID NO: 1-34, 101-109, or 114-189 or SEQ ID NO: 35 or 191-194) so long as immunospecific binding to GITR (e.g., human GITR) is maintained (e.g., substantially maintained, for example, at least 50%, at least 60%, at least 70%, at least 80%, at least 90%, at least 95%). In another embodiment, the amino terminus of a VL CDR1, VL CDR2, VL CDR3, VH CDR1, VH CDR2, and/or VH CDR3 described herein may be extended by one, two, three, four, five or more amino acids compared to one or more of the CDRs described herein (e.g., SEQ ID NO: 1-34, 101-109, or 114-189 or SEQ ID NO: 35 or 191-194) so long as immunospecific binding to GITR (e.g., human GITR) is maintained (e.g., substantially maintained, for example, at least 50%, at least 60%, at least 70%, at least 80%, at least 90%, at least 95%). In another embodiment, the carboxy terminus of a VL CDR1, VL CDR2, VL CDR3, VH CDR1, VH CDR2, and/or VH CDR3 described herein may be extended by one, two, three, four, five or more amino acids compared to one or more of the CDRs described herein (e.g., SEQ ID NO: 1-34, 101-109, or 114-189 or SEQ ID NO: 35 or 191-194) so long as immunospecific binding to GITR (e.g., human GITR) is maintained (e.g., substantially maintained, for example, at least 50%, at least 60%, at least 70%, at least 80%, at least 90%, at least 95%). In another embodiment, the amino terminus of a VL CDR1, VL CDR2, VL CDR3, VH CDR1, VH CDR2, and/or VH CDR3 described herein may be shortened by one, two, three, four, five or more amino acids compared to one or more of the CDRs described herein (e.g., SEQ ID NO: 1-34, 101-109, or 114-189 or SEQ ID NO: 35 or 191-194) so long as immunospecific binding to GITR (e.g., human GITR) is maintained (e.g., substantially maintained, for example, at least 50%, at least 60%, at least 70%, at least 80%, at least 90%, at least 95%). In one embodiment, the carboxy terminus of a VL CDR1, VL CDR2, VL CDR3, VH CDR1, VH CDR2, and/or VH CDR3 described herein may be shortened by one, two, three, four, five or more amino acids compared to one or more of the CDRs described herein (e.g., SEQ ID NO: 1-34, 101-109, or 114-189 or SEQ ID NO: 35 or 191-194) so long as immunospecific binding to GITR (e.g., human GITR) is maintained (e.g., substantially maintained, for example, at least 50%, at least 60%, at least 70%, at least 80%, at least 90%, at least 95%). Any method known in the art can be used to ascertain whether immunospecific binding to GITR (e.g., human GITR) is maintained, for example, the binding assays and conditions described in the "Examples" section (Section 6) provided herein.

In specific aspects, provided herein is an antibody comprising an antibody light chain and heavy chain, e.g., a separate light chain and heavy chain. With respect to the light chain, in a specific embodiment, the light chain of an antibody described herein is a kappa light chain. In another specific embodiment, the light chain of an antibody described herein is a lambda light chain. In yet another specific embodiment, the light chain of an antibody described herein is a human kappa light chain or a human lambda light chain. In a particular embodiment, an antibody described herein, which immunospecifically binds to an GITR polypeptide (e.g., human GITR) comprises a light chain wherein the amino acid sequence of the VL domain comprises any amino acid sequence described herein (e.g., SEQ ID NO: 202, 204, 205, 207, 208, or 400-518), and wherein the constant region of the light chain comprises the amino acid sequence of a human kappa light chain constant region. In a particular embodiment, an antibody described herein, which immunospecifically binds to an GITR polypeptide (e.g., human GITR) comprises a light chain wherein the amino acid sequence of the VL domain comprises any amino acid sequence described herein (e.g., SEQ ID NO: 519), and wherein the constant region of the light chain comprises the amino acid sequence of a human kappa light chain constant region. In another particular embodiment, an antibody described herein, which immunospecifically binds an GITR (e.g., human GITR) comprises a light chain wherein the amino acid sequence of the VL domain can comprise any amino acid sequence described herein (e.g., SEQ ID NO: 202, 204, 205, 207, 208, or 400-518), and wherein the constant region of the light chain comprises the amino acid sequence of a human lambda light chain constant region. In another particular embodiment, an antibody described herein, which immunospecifically binds an GITR (e.g., human GITR) comprises a light chain wherein the amino acid sequence of the VL domain can comprise any amino acid sequence described herein (e.g., SEQ ID NO: 519), and wherein the constant region of the light chain comprises the amino acid sequence of a human lambda light chain constant region. In a specific embodiment, an antibody described herein, which immunospecifically binds to GITR (e.g., human GITR) comprises a light chain wherein the amino acid of the VL domain comprises (SEQ ID NOs: 207 or 208) and wherein the constant region of the light chain comprises the amino acid sequence of a human kappa or lambda light chain constant region. Non-limiting examples of human constant region sequences have been described in the art, e.g., see U.S. Pat. No. 5,693,780 and Kabat E A et al., (1991) supra.

In a particular embodiment, an antibody or fragment thereof described herein, which specifically binds to GITR (e.g., human GITR) comprises a light chain comprising the amino acid sequence selected from the group consisting of SEQ ID NO: 555, 556, 571-576, and 580. In a particular embodiment, an antibody or fragment thereof described herein, which specifically binds to GITR (e.g., human GITR) comprises a light chain comprising the amino acid sequence selected from the group consisting of SEQ ID NOs: 571-576.

With respect to the heavy chain, in a specific embodiment, the heavy chain of an antibody described herein can be an alpha (α), delta (δ), epsilon (ε), gamma (γ) or mu (μ) heavy chain. In another specific embodiment, the heavy chain of an antibody described can comprise a human alpha (α), delta (δ), epsilon (ε), gamma (γ) or mu (μ) heavy chain. In a particular embodiment, an antibody described herein, which immunospecifically binds to GITR (e.g., human GITR), comprises a heavy chain wherein the amino acid sequence of the VH domain can comprise any amino acid sequence described herein (e.g., any of SEQ ID NO: 201, 203, 206, or 215-389), and wherein the constant region of the heavy chain comprises the amino acid sequence of a human gamma (γ) heavy chain constant region. In a specific embodiment, an antibody described herein, which specifically binds to GITR (e.g., human GITR), comprises a heavy chain wherein the amino acid sequence of the VH domain comprises an amino acid sequence selected from the group consisting of SEQ ID NOs: 553, 554, 567-570, and 579, and wherein the constant region of the heavy chain comprises the amino acid of a human heavy chain described herein or known in the art. In a specific embodiment, an antibody described herein, which specifically binds to GITR (e.g., human GITR), comprises a heavy chain wherein the amino acid sequence of the VH domain comprises an amino acid sequence selected from the group consisting of SEQ ID NOs: 581 and 582, and wherein the constant region of the heavy chain comprises the amino acid of a human heavy chain described herein or known in the art. Non-limiting examples of human constant region sequences have been described in the art, e.g., see U.S. Pat. No. 5,693,780 and Kabat E A et al., (1991) supra.

In a particular embodiment, an antibody or fragment thereof described herein, which specifically binds to GITR (e.g., human GITR), comprises a heavy chain comprising the amino acid sequence selected from the group consisting of SEQ ID NO: 553, 554, 567-570, and 579. In a particular embodiment, an antibody or fragment thereof described herein, which specifically binds to GITR (e.g., human GITR), comprises a heavy chain comprising the amino acid sequence selected from the group consisting of SEQ ID NO: 581 and 582. In a specific embodiment, an antibody or fragment thereof, which binds to GITR (e.g., human GITR), comprises a heavy chain comprising the amino acid sequence of SEQ ID NOs: 567-570.

In a specific embodiment, an antibody described herein, which immunospecifically binds to GITR (e.g., human GITR) comprises a VL domain and a VH domain comprising any amino acid sequences described herein, and wherein the constant regions comprise the amino acid sequences of the constant regions of an IgG, IgE, IgM, IgD, IgA or IgY immunoglobulin molecule, or a human IgG, IgE, IgM, IgD, IgA or IgY immunoglobulin molecule. In another specific embodiment, an antibody described herein, which immunospecifically binds to GITR (e.g., human GITR) comprises a VL domain and a VH domain comprising any amino acid sequences described herein, and wherein the constant regions comprise the amino acid sequences of the constant regions of an IgG, IgE, IgM, IgD, IgA or IgY immunoglobulin molecule, any class (e.g., $IgG_1$, $IgG_2$, $IgG_3$, $IgG_4$, $IgA_1$ and $IgA_2$), or any subclass (e.g., $IgG_{2a}$ and $IgG_{2b}$) of immunoglobulin molecule. In a particular embodiment, the constant regions comprise the amino acid sequences of the constant regions of a human IgG, IgE, IgM, IgD, IgA or IgY immunoglobulin molecule, any class (e.g., $IgG_1$, $IgG_2$, $IgG_3$, $IgG_4$, $IgA_1$ and $IgA_2$), or any subclass (e.g., $IgG_{2a}$ and $IgG_{2b}$) of immunoglobulin molecule.

In another specific embodiment, an antibody described herein, which immunospecifically binds to GITR (e.g., human GITR), comprises a VL domain and a VH domain comprising any amino acid sequences described herein, and wherein the constant regions comprise the amino acid sequences of the constant regions of a human $IgG_1$ (e.g., allotypes G1m3, G1m17,1 or G1m17,1,2) or human $IgG_4$. In a particular embodiment, an antibody described herein, which immunospecifically binds to an GITR (e.g., human GITR) comprises a VL domain and a VH domain comprising any amino acid sequences described herein, and wherein the constant regions comprise the amino acid sequences of the constant region of a human $IgG_1$ (allotype G1m3). Non-limiting examples of human constant regions are described in the art, e.g., see Kabat E A et al., (1991) supra.

In another embodiment, an antibody or fragment thereof described herein, which specifically binds to GITR (e.g., human GITR) comprises a light chain comprising the amino acid sequence selected from the group consisting of SEQ ID NO: 555, 556, 571-576, and 580 and a heavy chain comprising the amino acid sequence selected from the group consisting of SEQ ID NO: 553, 554, 567-570, and 579. In another embodiment, an antibody or fragment thereof described herein, which specifically binds to GITR (e.g., human GITR) comprises a light chain comprising the amino acid sequence of SEQ ID NO:576 and a heavy chain comprising the amino acid sequence selected from the group consisting of SEQ ID NO: 581 and 582. In a specific embodiment, an antibody or fragment thereof, which specifically binds to GITR (e.g., human GITR), comprises a light chain comprising the amino acid sequence of SEQ ID NO: 555 or 556 and a heavy chain comprising the amino acid sequence of SEQ ID NO: 554.

In certain embodiments, one, two or more mutations (e.g., amino acid substitutions) are introduced into the Fc region of an antibody described herein or a fragment thereof (e.g., CH2 domain (residues 231-340 of human $IgG_1$) and/or CH3 domain (residues 341-447 of human $IgG_1$) and/or the hinge region, with numbering according to the Kabat numbering system (e.g., the EU index in Kabat)) to alter one or more functional properties of the antibody, such as serum half-life, complement fixation, Fc receptor binding and/or antigen-dependent cellular cytotoxicity.

In certain embodiments, one, two or more mutations (e.g., amino acid substitutions) are introduced into the hinge region of the Fc region (CH1 domain) such that the number of cysteine residues in the hinge region are altered (e.g., increased or decreased) as described in, e.g., U.S. Pat. No. 5,677,425. The number of cysteine residues in the hinge region of the CH1 domain may be altered to, e.g., facilitate assembly of the light and heavy chains, or to alter (e.g., increase or decrease) the stability of the antibody.

In some embodiments, one, two or more mutations (e.g., amino acid substitutions) are introduced into the Fc region of an antibody described herein or a fragment thereof (e.g., CH2 domain (residues 231-340 of human $IgG_1$) and/or CH3 domain (residues 341-447 of human $IgG_1$) and/or the hinge region, with numbering according to the Kabat numbering system (e.g., the EU index in Kabat)) to increase or decrease the affinity of the antibody for an Fc receptor (e.g., an activated Fc receptor) on the surface of an effector cell. Mutations in the Fc region of an antibody or fragment thereof that decrease or increase the affinity of an antibody for an Fc receptor and techniques for introducing such mutations into the Fc receptor or fragment thereof are known to one of skill in the art. Examples of mutations in the Fc receptor of an antibody that can be made to alter the affinity of the antibody for an Fc receptor are described in, e.g., Smith P et al., (2012) PNAS 109: 6181-6186, U.S. Pat. No. 6,737,056, and International Publication Nos. WO 02/060919; WO 98/23289; and WO 97/34631, which are incorporated herein by reference.

In a specific embodiment, one, two or more amino acid mutations (i.e., substitutions, insertions or deletions) are introduced into an IgG constant domain, or FcRn-binding fragment thereof (preferably an Fc or hinge-Fc domain fragment) to alter (e.g., decrease or increase) half-life of the antibody in vivo. See, e.g., International Publication Nos. WO 02/060919; WO 98/23289; and WO 97/34631; and U.S. Pat. Nos. 5,869,046, 6,121,022, 6,277,375 and 6,165,745 for examples of mutations that will alter (e.g., decrease or increase) the half-life of an antibody in vivo. In some embodiments, one, two or more amino acid mutations (i.e., substitutions, insertions or deletions) are introduced into an IgG constant domain, or FcRn-binding fragment thereof (preferably an Fc or hinge-Fc domain fragment) to decrease the half-life of the antibody in vivo. In other embodiments, one, two or more amino acid mutations (i.e., substitutions, insertions or deletions) are introduced into an IgG constant domain, or FcRn-binding fragment thereof (preferably an Fc or hinge-Fc domain fragment) to increase the half-life of the antibody in vivo. In a specific embodiment, the antibodies may have one or more amino acid mutations (e.g., substitutions) in the second constant (CH2) domain (residues 231-340 of human IgG$_1$) and/or the third constant (CH3) domain (residues 341-447 of human IgG$_1$), with numbering according to the EU index in Kabat (Kabat E A et al., (1991) supra). In a specific embodiment, the constant region of the IgG$_1$ of an antibody or antigen-binding fragment thereof described herein comprises a methionine (M) to tyrosine (Y) substitution in position 252, a serine (S) to threonine (T) substitution in position 254, and a threonine (T) to glutamic acid (E) substitution in position 256, numbered according to the EU index as in Kabat. See U.S. Pat. No. 7,658,921, which is incorporated herein by reference. This type of mutant IgG, referred to as "YTE mutant" has been shown to display fourfold increased half-life as compared to wild-type versions of the same antibody (see Dall'Acqua W F et al., (2006) J Biol Chem 281: 23514-24). In certain embodiments, an antibody or antigen-binding fragment thereof comprises an IgG constant domain comprising one, two, three or more amino acid substitutions of amino acid residues at positions 251-257, 285-290, 308-314, 385-389, and 428-436, numbered according to the EU index as in Kabat.

In a further embodiment, one, two or more amino acid substitutions are introduced into an IgG constant domain Fc region to alter the effector function(s) of the antibody. For example, one or more amino acids selected from amino acid residues 234, 235, 236, 237, 297, 318, 320 and 322, numbered according to the EU index as in Kabat, can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260. In some embodiments, the deletion or inactivation (through point mutations or other means) of a constant region domain may reduce Fc receptor binding of the circulating antibody thereby increasing tumor localization. See, e.g., U.S. Pat. Nos. 5,585,097 and 8,591,886 for a description of mutations that delete or inactivate the constant domain and thereby increase tumor localization. In certain embodiments, one or more amino acid substitutions may be introduced into the Fc region of an antibody described herein to remove potential glycosylation sites on Fc region, which may reduce Fc receptor binding (see, e.g., Shields R L et al., (2001) J Biol Chem 276: 6591-604). In various embodiments, one or more of the following mutations in the constant region of an antibody described herein may be made: an N297A substitution; an N297Q substitution; a L235A substitution and a L237A substitution; a L234A substitution and a L235A substitution; a E233P substitution; a L234V substitution; a L235A substitution; a C236 deletion; a P238A substitution; a D265A substitution; a A327Q substitution; or a P329A substitution, numbered according to the EU index as in Kabat.

In a specific embodiment, an antibody or antigen-binding fragment thereof described herein comprises the constant domain of an IgG$_1$ with an N297Q or N297A amino acid substitution.

In certain embodiments, one or more amino acids selected from amino acid residues 329, 331 and 322 in the constant region of an antibody described herein, numbered according to the EU index as in Kabat, can be replaced with a different amino acid residue such that the antibody has altered C1q binding and/or reduced or abolished complement dependent cytotoxicity (CDC). This approach is described in further detail in U.S. Pat. No. 6,194,551 (Idusogie et al). In some embodiments, one or more amino acid residues within amino acid positions 231 to 238 in the N-terminal region of the CH2 domain of an antibody described herein are altered to thereby alter the ability of the antibody to fix complement. This approach is described further in International Publication No. WO 94/29351. In certain embodiments, the Fc region of an antibody described herein is modified to increase the ability of the antibody to mediate antibody dependent cellular cytotoxicity (ADCC) and/or to increase the affinity of the antibody for an Fcγ receptor by mutating one or more amino acids (e.g., introducing amino acid substitutions) at the following positions: 238, 239, 248, 249, 252, 254, 255, 256, 258, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 333, 334, 335, 337, 338, 340, 360, 373, 376, 378, 382, 388, 389, 398, 414, 416, 419, 430, 434, 435, 437, 438 or 439, numbered according to the EU index as in Kabat. This approach is described further in International Publication No. WO 00/42072.

In certain embodiments, an antibody described herein comprises the constant region of an IgG$_4$ antibody and the serine at amino acid residue 228 of the heavy chain, numbered according to the EU index as in Kabat, is substituted for proline.

Antibodies with reduced fucose content have been reported to have an increased affinity for Fc receptors, such as, e.g., FcγRIIIa. Accordingly, in certain embodiments, the antibodies or antigen-binding fragments thereof described herein have reduced fucose content or no fucose content. Such antibodies can be produced using techniques known to one skilled in the art. For example, the antibodies can be expressed in cells deficient or lacking the ability of fucosylation. In a specific example, cell lines with a knockout of both alleles of α1,6-fucosyltransferase can be used to produce antibodies with reduced fucose content. The Potelligent® system (Lonza) is an example of such a system that can be used to produce antibodies with reduced fucose content. Alternatively, antibodies or antigen-binding fragments with reduced fucose content or no fucose content can be produced by, e.g.: (i) culturing cells under conditions which prevent or reduce fucosylation; (ii) posttranslational removal of fucose (e.g., with a fucosidase enzyme); (iii) post-translational addition of the desired carbohydrate, e.g., after recombinant expression of a non-glycosylated glycoprotein; or (iv) purification of the glycoprotein so as to select for antibodies or antigen-binding fragments thereof which are not fucsoylated. See, e.g., Longmore G D & Schachter H (1982) Carbohydr Res 100: 365-92 and Imai-Nishiya H et al., (2007) BMC Biotechnol. 7: 84 for methods for producing antibodies or antigen-binding fragments thereof with no fucose content or reduced fucose content.

In certain embodiments, antibodies or antigen-binding fragments thereof described herein have an increased affinity for CD32B (also known as FcγRIIB or FCGR2B), e.g., as compared to an antibody with a wild-type Fc region, e.g., an IgG1 Fc. In certain embodiments, antibodies or antigen-binding fragments thereof described herein have a selectively increased affinity for CD32B (FcγRIIB) over both CD32A (FcγRIIA) and CD16 (FcγRIIIA). Sequence alterations that result in increased affinity for CD32B are provided, for example, in Mimoto et al., *Protein Engineering, Design & Selection* 10: 589-598 (2013), Chu et al., *Molecular Immunology* 45: 3926-3933 (2008), and Strohl, *Current Opinion in Biology* 20: 685-691 (2009), each of which is herein incorporated by reference in its entirety. In some embodiments, the antibody or antigen-binding fragment with an increased affinity for CD32B comprises a heavy chain constant region, e.g., an IgG1 constant region, or fragment thereof comprising a mutation selected from the group consisting of: G236D, P238D, S239D, S267E, L328F, L328E, an arginine inserted after position 236, and combinations thereof, numbered according to EU index (Kabat et al., Sequences of Proteins of Immunological Interest, U.S. Department of Health and Human Services, Bethesda (1991)). In some embodiments, the antibody or antigen-binding fragment with an increased affinity for CD32B comprises a heavy chain constant region, e.g., an IgG1 constant region, or fragment thereof comprising S267E and L328F substitutions. In some embodiments, the antibody or antigen-binding fragment with an increased affinity for CD32B comprises a heavy chain constant region, e.g., an IgG1 constant region, or fragment thereof comprising P238D and L328E substitutions. In some embodiments, the antibody or antigen-binding fragment with an increased affinity for CD32B comprises a heavy chain constant region, e.g., an IgG1 constant region, or fragment thereof comprising a P238D substitution and substitution selected from the group consisting of E233D, G237D, H268D, P271G, A330R, and combinations thereof. In some embodiments, the antibody or antigen-binding fragment with an increased affinity for CD32B comprises a heavy chain constant region, e.g., an IgG1 constant region, or fragment thereof comprising P238D, E233D, G237D, H268D, P271G, and A330R substitutions. In some embodiments, the antibody or antigen-binding fragment with an increased affinity for CD32B comprises a heavy chain constant region, e.g., an IgG1 constant region, or fragment thereof comprising G236D and S267E. In some embodiments, the antibody or antigen-binding fragment with an increased affinity for CD32B comprises a heavy chain constant region, e.g., an IgG1 constant region, or fragment thereof comprising S239D and S267E. In some embodiments, the antibody or antigen-binding fragment with an increased affinity for CD32B comprises a heavy chain constant region, e.g., an IgG1 constant region, or fragment thereof comprising S267E and L328F. In some embodiments, the antibody or antigen-binding fragment with an increased affinity for CD32B comprises a heavy chain constant region, e.g., an IgG1 constant region, or fragment thereof comprising an arginine inserted after position 236 and L328R.

In another particular embodiment, an antibody described herein, which immunospecifically binds to GITR (e.g., human GITR), comprises a light chain and a heavy chain, wherein (i) the light chain comprises a VL domain comprising a VL CDR1, VL CDR2, and VL CDR3 having the amino acid sequences of any one of Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161 (e.g., those listed in Table 1); (ii) the heavy chain comprises a VH domain comprising a VH CDR1, VH CDR2, and VH CDR3 having the amino acid sequences of any one of Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161 (e.g., those listed in Table 2); (iii) the light chain further comprises a constant light chain domain comprising the amino acid sequence of the constant domain of a human kappa light chain; and (iv) the heavy chain further comprises a constant heavy chain domain comprising the amino acid sequence of the constant domain of a human $IgG_1$ (optionally $IgG_1$ (allotype G1m3)) heavy chain.

In another particular embodiment, an antibody described herein, which immunospecifically binds to GITR (e.g., human GITR), comprises a light chain and a heavy chain, wherein (i) the light chain comprises a VL domain comprising the amino acid sequence of any one of the antibodies Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161, (e.g., SEQ ID NO: 202, 204, 205, 207, 208, or 400-518 or SEQ ID NO:519); (ii) the heavy chain comprises a VH domain comprising the amino acid sequence of and one of the antibodies Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161, (e.g., SEQ ID NO: 201, 203, 206, or 215-389); (iii) the light chain further comprises a constant domain comprising the amino acid sequence of the constant domain of a human kappa light chain; and (iv) the heavy chain further comprises a constant domain comprising the amino acid sequence of the constant domain of a human $IgG_1$ (optionally $IgG_1$ (allotype G1m3)) heavy chain.

In another particular embodiment, an antibody described herein, which immunospecifically binds to GITR (e.g., human GITR), comprises a light chain and a heavy chain, wherein (i) the light chain comprises a VL domain comprising the amino acid sequence of Hum231#1 or Hum231#2 (e.g., SEQ ID NO: 207 or 208); (ii) the heavy chain comprises a VH domain comprising the amino acid sequence of Hum231#1 or Hum231#2 (e.g., SEQ ID NO: 206); (iii) the light chain further comprises a constant domain comprising the amino acid sequence of the constant domain of a human kappa light chain; and (iv) the heavy chain further comprises a constant domain comprising the amino acid sequence of the constant domain of a human $IgG_1$ (optionally $IgG_1$ (allotype G1m3)) heavy chain.

In another particular embodiment, an antibody described herein, which immunospecifically binds to GITR (e.g., human GITR), comprises a light chain and a heavy chain, wherein (i) the light chain comprises a VL domain comprising a VL CDR1, VL CDR2, and VL CDR3 having the amino acid sequences of any one of the antibodies described herein, e.g., Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161 (e.g., those listed in Table 1); (ii) the heavy chain comprises a VH domain comprising a VH CDR1, VH CDR2, and VH CDR3 having the amino acid sequences of any one of the antibodies described herein, e.g., Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161 (e.g., those listed in Table 2); (iii) the light chain further comprises a constant light chain domain comprising the amino acid sequence of the constant domain of a human $IgG_4$; and (iv) the heavy chain further comprises a constant heavy chain domain comprising the amino acid sequence of the constant domain of a human $IgG_4$ heavy chain.

In another particular embodiment, an antibody described herein, which immunospecifically binds to GITR (e.g., human GITR), comprises a light chain and a heavy chain, wherein (i) the light chain comprises a VL domain comprising the amino acid sequence of any one of the antibodies described herein, e.g., Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161 (e.g., SEQ ID NO: 202, 204, 205, 207, 208, or 400-518 or SEQ ID NO: 519); (ii) the heavy chain comprises a VH domain comprising the amino acid sequence of any one of the antibodies described herein, e.g., Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161 (e.g., SEQ ID NO: 201, 203, 206, or 215-389); (iii) the light chain further comprises a constant domain comprising the amino acid sequence of the constant domain of a human IgG$_4$ light chain; and (iv) the heavy chain further comprises a constant domain comprising the amino acid sequence of the constant domain of a human IgG$_4$ heavy chain.

In another particular embodiment, an antibody described herein, which immunospecifically binds to GITR (e.g., human GITR), comprises a light chain and a heavy chain, wherein (i) the light chain comprises a VL domain comprising the amino acid sequence of either Hum231#1 or Hum231#2 (e.g., SEQ ID NO: 207 or 208); (ii) the heavy chain comprises a VH domain comprising the amino acid sequence of either Hum231#1 or Hum231#2 (e.g., SEQ ID NO: 206); (iii) the light chain further comprises a constant domain comprising the amino acid sequence of the constant domain of a human IgG$_4$ light chain; and (iv) the heavy chain further comprises a constant domain comprising the amino acid sequence of the constant domain of a human IgG$_4$ heavy chain.

In a specific embodiment, an antibody provided herein, which specifically binds to GITR (e.g., human GITR), comprises (a) a heavy chain comprising an amino acid sequence selected from the group consisting of SEQ ID NO: 553, 554, and 567 to 570; and (b) a light chain comprising an amino acid sequence selected from the group consisting of SEQ ID NO: 555, 556, and 571 to 576. In a specific embodiment, an antibody provided herein, which specifically binds to GITR (e.g., human GITR), comprises (a) a heavy chain comprising an amino acid sequence selected from the group consisting of SEQ ID NO: 581 or 582; and (b) a light chain comprising the amino acid sequence of SEQ ID NO: 576. In another specific embodiment, an antibody provided herein, which specifically binds to GITR (e.g., human GITR), comprises (a) a heavy chain comprising the amino acid sequence of SEQ ID NO: 553; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 554; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 581; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 582; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 553; and (b) a light chain comprising the amino acid sequence of SEQ ID NO: 555. In another specific embodiment, an antibody provided herein, which specifically binds to GITR (e.g., human GITR), comprises (a) a heavy chain comprising the amino acid sequence of SEQ ID NO: 554; and (b) a light chain comprising the amino acid sequence of SEQ ID NO: 555. In another specific embodiment, an antibody provided herein, which specifically binds to GITR (e.g., human GITR), comprises (a) a heavy chain comprising the amino acid sequence of SEQ ID NO: 567; and (b) a light chain comprising the amino acid sequence of SEQ ID NO: 573. In another specific embodiment, an antibody provided herein, which specifically binds to GITR (e.g., human GITR), comprises (a) a heavy chain comprising the amino acid sequence of SEQ ID NO: 567; and (b) a light chain comprising the amino acid sequence of SEQ ID NO: 576. In another specific embodiment, an antibody provided herein, which specifically binds to GITR (e.g., human GITR), comprises (a) a heavy chain comprising the amino acid sequence of SEQ ID NO: 554; and (b) a light chain comprising the amino acid sequence of SEQ ID NO: 576. In another specific embodiment, an antibody provided herein, which specifically binds to GITR (e.g., human GITR), comprises (a) a heavy chain comprising the amino acid sequence of SEQ ID NO: 581; and (b) a light chain comprising the amino acid sequence of SEQ ID NO: 576. In another specific embodiment, an antibody provided herein, which specifically binds to GITR (e.g., human GITR), comprises (a) a heavy chain comprising the amino acid sequence of SEQ ID NO: 582; and (b) a light chain comprising the amino acid sequence of SEQ ID NO: 576.

In another specific embodiment, an antibody provided herein, which specifically binds to GITR (e.g., human GITR), comprises (a) a heavy chain comprising the amino acid sequence of SEQ ID NO: 553 with an amino acid substitution of N to A or Q at amino acid position 298; and (b) a light chain comprising an amino acid sequence selected from the group consisting of SEQ ID NO: 555, 556, and 571 to 576. In another specific embodiment, an antibody provided herein, which specifically binds to GITR (e.g., human GITR), comprises (a) a heavy chain comprising the amino acid sequence of SEQ ID NO: 553 with an amino acid substitution of N to A or Q at amino acid position 298; and (b) a light chain comprising the amino acid sequence of SEQ ID NO: 556. In another specific embodiment, an antibody provided herein, which specifically binds to GITR (e.g., human GITR), comprises (a) a heavy chain comprising the amino acid sequence of SEQ ID NO: 553 with an amino acid substitution of N to A or Q at amino acid position 298; and (b) a light chain comprising the amino acid sequence of SEQ ID NO: 555.

In certain embodiments, an antibody or fragment thereof described herein, which specifically binds to GITR (e.g., human GITR), comprises one, two, three, or four VL framework regions (FRs) having the amino acid sequence described herein for any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., see Table 3). In some embodiments an antibody or fragment thereof, which specifically binds to GITR (e.g., human GITR) comprises one, two, three, or four VH framework regions (FRs) having the amino acid sequence described herein for any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., see Table 4). In certain embodiments, an antibody or fragment thereof, which specifically binds to GITR (e.g., human GITR), comprises one, two, three, four, five, six, seven, or eight of the FRs of one of the antibodies described herein (e.g., Hum231#1 Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161). In specific embodiments, an antibody or fragment thereof described herein, which immunospecifically binds to GITR (e.g., human GITR), comprises framework regions (e.g., framework regions of the VL domain and/or VH domain) that are human framework regions or derived from human framework regions. Non-limiting examples of human framework regions are described in the art, e.g., see Kabat E A et al., (1991) supra). In certain embodiment, an antibody described herein comprises framework regions (e.g., framework regions of the VL domain and/or VH domain) that are primate (e.g., non-human primate) framework regions or derived from primate (e.g., non-human primate) framework regions.

For example, CDRs from antigen-specific non-human antibodies, typically of rodent origin (e.g., mouse or rat), are grafted onto homologous human or non-human primate acceptor frameworks. In one embodiment, the non-human primate acceptor frameworks are from Old World apes. In a specific embodiment, the Old World ape acceptor framework is from *Pan troglodytes, Pan paniscus* or *Gorilla gorilla*. In a particular embodiment, the non-human primate acceptor frameworks are from the chimpanzee *Pan troglodytes*. In a particular embodiment, the non-human primate acceptor frameworks are Old World monkey acceptor frameworks. In a specific embodiment, the Old World monkey acceptor frameworks are from the genus *Macaca*. In a certain embodiment, the non-human primate acceptor frameworks are is derived from the cynomolgus monkey *Macaca* cynomolgus. Non-human primate framework sequences are described in U.S. Patent Application Publication No. US 2005/0208625.

In certain embodiments, an antibody or fragment thereof described herein, which specifically binds to GITR (e.g., human GITR), comprises one, two or more VL framework regions (FRs) having the amino acid sequences described herein for any one of the antibodies set forth in Table 3, supra. In some embodiments, an antibody or fragment thereof described herein, which specifically binds to GITR (e.g., human GITR), comprises one, two or more VH framework regions (FRs) having the amino acid sequences described herein for any one of the antibodies set forth in Table 4, supra. In specific embodiments, an antibody or fragment thereof described herein, which specifically binds to GITR (e.g., human GITR), comprises one, two or more VL framework regions having the amino acid sequences described herein for any one of the antibodies set forth in Table 3, supra, and one, two or more VH framework regions having the amino acid sequences described herein for the antibodies set forth in Table 4, supra.

In certain embodiments, an antibody or fragment thereof described herein, which specifically binds to GITR (e.g., human GITR), comprises the framework regions of VL domain having the amino acid sequence selected from the group consisting of SEQ ID NO: 202, 207, 208, 400-411, 413-416, 418-421, 423-448, 450-452, 454-464, 467-477, 481-486, 488-513, or 515-518 and/or the framework regions of the VH domain having the amino acid sequence selected from the group consisting of SEQ ID NO: 201, 206, 215, 217-234, 236-256, 258, 259, 261-265, 267, 268, 271-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, 362-368, 380, 384, or 387. In certain embodiments, an antibody or fragment thereof described herein, which specifically binds to GITR (e.g., human GITR), comprises the framework regions of VL domain having the amino acid sequence selected from the group consisting of SEQ ID NO: 202, 207, 208, 400-411, 413-416, 418-421, 423-448, 450-464, 467-477, 481-486, 488-513, or 515-519 and/or the framework regions of the VH domain having the amino acid sequence selected from the group consisting of SEQ ID NO: 201, 206, 215, 217-234, 236-256, 258, 259, 261-265, 267, 268, 270-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, or 362-368. In some embodiments, an antibody or fragment thereof described herein, which specifically binds to GITR (e.g., human GITR), comprises one, two, three or four framework regions of the VL domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107 (e.g., SEQ ID NO: 202, 207, 208, 400-411, 413-416, 418-421, 423-448, 450-452, 454-464, 467-477, 481-486, 488-513, or 515-518) with 1, 2, 3, 4, 5, 6, 7, 8, 9 or more amino acid mutations (e.g., amino acid substitutions, such as conservative amino acid substitutions) and/or the framework regions of the VH domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107 (e.g., SEQ ID NO: 201, 206, 215, 217-234, 236-256, 258, 259, 261-265, 267, 268, 271-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, 362-368, 380, 384, or 387). In some embodiments, an antibody or fragment thereof described herein, which specifically binds to GITR (e.g., human GITR), comprises one, two, three or four framework regions of the VL domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., SEQ ID NO: 202, 207, 208, 400-411, 413-416, 418-421, 423-448, 450-464, 467-477, 481-486, 488-513, or 515-519) with 1, 2, 3, 4, 5, 6, 7, 8, 9 or more amino acid mutations (e.g., amino acid substitutions, such as conservative amino acid substitutions) and/or the framework regions of the VH domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., SEQ ID NO: 201, 206, 215, 217-234, 236-256, 258, 259, 261-265, 267, 268, 270-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, or 362-368). In certain embodiments, an antibody or fragment thereof described herein, which specifically binds to GITR (e.g., human GITR), comprises one, two, three or four framework regions of the VH domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, pab2161 (e.g., SEQ ID NO: 201, 203, 206, or 215-389) with 1, 2, 3, 4, 5, 6, 7, 8, 9 or more amino acid mutations (e.g., amino acid substitutions, such as conservative amino acid substitutions) and/or the framework regions of the VL domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., SEQ ID NO: 201, 203, 206, or 215-389). In some embodiments, an antibody or fragment thereof described herein, which specifically binds to GITR (e.g., human GITR), comprises one, two, three or four framework regions of the VL domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107 (e.g., SEQ ID NO: 202, 207, 208, 400-411, 413-416, 418-421, 423-448, 450-452, 454-464, 467-477, 481-486, 488-513, or 515-518) with 1, 2, 3, 4, 5, 6, 7, 8, 9 or more amino acid mutations (e.g., amino acid substitutions, such as conservative amino acid substitutions) and/or one, two, three or four framework regions of the VH domain having the amino acid sequence of SEQ ID NO: 201, 203, 206, or 215-389 with 1, 2, 3, 4, 5, 6, 7, 8, 9 or more amino acid mutations (e.g., amino acid substitutions, such as conservative amino acid substitutions). In some embodiments, an antibody or fragment thereof described herein, which specifically binds to GITR (e.g., human GITR), comprises one, two, three or four framework regions of the VL domain having the amino acid sequence of any one of the antibodies described herein, e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., SEQ ID NO: 202, 207, 208, 400-411, 413-416, 418-421, 423-448, 450-464, 467-477, 481-486, 488-513, or 515-519) with 1, 2, 3, 4, 5, 6, 7, 8, 9 or more amino acid mutations (e.g., amino acid substitutions, such as conservative amino acid substitutions) and/or one, two, three or four framework regions of the VH domain having the amino acid sequence of SEQ ID NO: 201, 203, 206, or 215-389 with 1, 2, 3, 4, 5, 6, 7, 8, 9 or more amino acid mutations (e.g., amino acid substitutions, such as conservative amino acid substitutions).

In certain embodiments, an antibody or fragment thereof described herein, which specifically binds to GITR (e.g., human GITR), comprises VL framework regions (FRs) having at least 80%, at least 85%, at least 90%, at least 95%, or at least 98% sequence identity to the VL framework regions described herein in Table 3, supra. In certain embodiments, an antibody or fragment thereof described herein, which specifically binds to GITR (e.g., human GITR), comprises VH framework regions (FRs) having at least 80%, at least 85%, at least 90%, at least 95%, or at least 98% sequence identity to the VH framework regions described herein Table 4, supra. In some embodiments, an antibody or fragment thereof described herein, which specifically binds to GITR (e.g., human GITR), comprises VH framework regions (FRs) having at least 80%, at least 85%, at least 90%, at least 95%, or at least 98% sequence identity to the VH framework regions described herein Table 4, supra, and VL framework regions (FRs) having at least 80%, at least 85%, at least 90%, at least 95%, or at least 98% sequence identity to the VL framework regions described herein Table 3, supra.

In certain embodiments, an antibody or fragment thereof described herein, which specifically binds to GITR (e.g., human GITR), comprises VL framework regions (FRs) having at least 80%, at least 85%, at least 90%, at least 95%, or at least 98% sequence identity to the VL framework regions described herein for antibody Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., as set forth in Table 3). In some embodiments, an antibody or fragment thereof described herein, which specifically binds to GITR (e.g., human GITR), comprises VH framework regions (FRs) having at least 80%, at least 85%, at least 90%, at least 95%, or at least 98% sequence identity to the VH framework regions described herein for antibody Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., as set forth in Table 4). In certain embodiments, an antibody or fragment thereof described herein, which specifically binds to GITR (e.g., human GITR), comprises: (i) VL framework regions (FRs) having at least 80%, at least 85%, at least 90%, at least 95%, or at least 98% sequence identity to the VL framework regions described herein for Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., as set forth in Table 3); and (ii) VH framework regions (FRs) having at least 80%, at least 85%, at least 90%, at least 95%, or at least 98% sequence identity to the VH framework regions described herein for Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 (e.g., as set forth in Table 4).

The determination of percent identity between two sequences (e.g., amino acid sequences or nucleic acid sequences) can also be accomplished using a mathematical algorithm. A specific, non-limiting example of a mathematical algorithm utilized for the comparison of two sequences is the algorithm of Karlin S & Altschul S F (1990) PNAS 87: 2264-2268, modified as in Karlin S & Altschul S F (1993) PNAS 90: 5873-5877. Such an algorithm is incorporated into the NBLAST and XBLAST programs of Altschul S F et al., (1990) J Mol Biol 215: 403. BLAST nucleotide searches can be performed with the NBLAST nucleotide program parameters set, e.g., for score=100, wordlength=12 to obtain nucleotide sequences homologous to a nucleic acid molecules described herein. BLAST protein searches can be performed with the XBLAST program parameters set, e.g., to score 50, wordlength=3 to obtain amino acid sequences homologous to a protein molecule described herein. To obtain gapped alignments for comparison purposes, Gapped BLAST can be utilized as described in Altschul S F et al., (1997) Nuc Acids Res 25: 3389 3402. Alternatively, PSI BLAST can be used to perform an iterated search which detects distant relationships between molecules (Id.). When utilizing BLAST, Gapped BLAST, and PSI Blast programs, the default parameters of the respective programs (e.g., of XBLAST and NBLAST) can be used (see, e.g., National Center for Biotechnology Information (NCBI) on the worldwide web, ncbi.nlm.nih.gov). Another specific, non limiting example of a mathematical algorithm utilized for the comparison of sequences is the algorithm of Myers and Miller, 1988, CABIOS 4:11 17. Such an algorithm is incorporated in the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

The percent identity between two sequences can be determined using techniques similar to those described above, with or without allowing gaps. In calculating percent identity, typically only exact matches are counted.

In certain embodiments, an antibody or fragment thereof, which immunospecifically binds to GITR (e.g., human GITR), comprises a VL domain having at least 80%, at least 85%, at least 90%, at least 95%, or at least 98% sequence identity to the amino acid sequence of the VL domain of any one of antibodies Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161 (e.g., SEQ ID NO: 202, 204, 205, 207, 208, or 400-518 or SEQ ID NO:519). In certain embodiments, an antibody or fragment thereof, which immunospecifically binds to GITR (e.g., human GITR), comprises a VL domain having at least 80%, at least 85%, at least 90%, at least 95%, or at least 98% sequence identity to the amino acid sequence of the VL domain of any one of antibodies Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, Hum231#1, 231-32-15, or antibodies 1-107, or antibodies pab2159, pab2160, or pab2161, (e.g., SEQ ID NO: 202, 204, 205, 207, 208, or 400-518 or SEQ ID NO:519), wherein the antibody or antigen-binding fragment comprises CDRs (e.g., VL CDRs) that are identical to the CDRs (e.g., VL CDRs) of an antibody set forth in Table 1 and/or Table 2 (e.g., the CDRs are identical to the CDRs of a particular antibody referred to by name in Tables 1 and/or 2).

In certain embodiments, an antibody or fragment thereof, which immunospecifically binds to GITR (e.g., human GITR), comprises a VL domain comprising VL framework regions having at least 80%, at least 85%, at least 90%, at least 95%, or at least 98% sequence identity to the amino acid sequence of the framework regions selected from the group consisting of SEQ ID NO: 202, 204, 205, 207, 208, and 400-518. In certain embodiments, an antibody or fragment thereof, which immunospecifically binds to GITR (e.g., human GITR), comprises a VL domain comprising VL framework regions having at least 80%, at least 85%, at least 90%, at least 95%, or at least 98% sequence identity to the amino acid sequence of SEQ ID NO: 519. In a particular embodiment, the antibody comprises VL CDRs that are identical to the VL CDRs of an antibody set forth in Table 1 (e.g., the VL CDRs in one row in Table 1).

In certain embodiments, an antibody or fragment thereof, which immunospecifically binds to GITR (e.g., human GITR), comprises a VH domain having at least 80%, at least 85%, at least 90%, at least 95%, or at least 98% sequence identity to the amino acid sequence of the VH domain of SEQ ID NO: 201, 203, 206, or 215-389. In certain embodiments, an antibody or fragment thereof, which immunospecifically binds to GITR (e.g., human GITR), comprises a VH domain having at least 80%, at least 85%, at least 90%, at least 95%, or at least 98% sequence identity to the amino acid sequence of the VH domain of SEQ ID NO: 201, 203, 206, or 215-389, wherein the antibody or antigen-binding fragment comprises CDRs (e.g., VL CDRs) that are identical to the CDRs (e.g., VL CDRs) of an antibody set forth in Table 1 and/or Table 2 (e.g., the CDRs are identical to the CDRs of a particular named antibody referred to by name in Tables 1 and/or 2).

In certain embodiments, an antibody or fragment thereof, which immunospecifically binds to GITR (e.g., human GITR), comprises a VH domain comprising VH framework regions having at least 80%, at least 85%, at least 90%, at least 95%, or at least 98% sequence identity to the amino acid sequence of the framework regions selected from the group consisting of SEQ ID NO: 201, 203, 206, and 215-389. In a particular embodiment, the antibody comprises VH CDRs that are identical to the VH CDRs of an antibody set forth in Table 2 (e.g., the VH CDRs in one row in Table 2).

In certain embodiments, an antibody or fragment thereof, which immunospecifically binds to GITR (e.g., human GITR), comprises: (i) a VL domain having at least 80%, at least 85%, at least 90%, at least 95%, or at least 98% sequence identity to the amino acid sequence of the VL domain selected from the group consisting of SEQ ID NO: 202, 204, 205, 207, 208, and 400-518; and (ii) a VL domain having at least 80%, at least 85%, at least 90%, at least 95%, or at least 98% sequence identity to the amino acid sequence of the VH domain of SEQ ID NO: 201, 203, 206, or 215-389. In certain embodiments, an antibody or fragment thereof, which immunospecifically binds to GITR (e.g., human GITR), comprises: (i) a VL domain having at least 80%, at least 85%, at least 90%, at least 95%, or at least 98% sequence identity to the amino acid sequence of SEQ ID NO: 519; and (ii) a VL domain having at least 80%, at least 85%, at least 90%, at least 95%, or at least 98% sequence identity to the amino acid sequence of the VH domain of SEQ ID NO: 304. In certain embodiments, an antibody or fragment thereof, which immunospecifically binds to GITR (e.g., human GITR), comprises: (i) a VL domain having at least 80%, at least 85%, at least 90%, at least 95%, or at least 98% sequence identity to the amino acid sequence of the VL domain selected from the group consisting of SEQ ID NO:

202, 204, 205, 207, 208, and 400-518; and (ii) a VH domain having at least 80%, at least 85%, at least 90%, at least 95%, or at least 98% sequence identity to the amino acid sequence of the VH domain selected from the group of SEQ ID NO: 201, 203, 206, and 215-389, wherein the antibody or antigen-binding fragment comprises CDRs (e.g., VL CDRs) that are identical to the CDRs (e.g., VL CDRs) of an antibody set forth in Table 1 and/or Table 2 (e.g., the CDRs are identical to the CDRs of a particular antibody referred to by name in Tables 1 and/or 2). In certain embodiments, an antibody or fragment thereof, which immunospecifically binds to GITR (e.g., human GITR), comprises: (i) a VL domain having at least 80%, at least 85%, at least 90%, at least 95%, or at least 98% sequence identity to the amino acid sequence of SEQ ID NO:519; and (ii) a VH domain having at least 80%, at least 85%, at least 90%, at least 95%, or at least 98% sequence identity to the amino acid sequence of SEQ ID NO:304, wherein the antibody or antigen-binding fragment comprises CDRs (e.g., VL CDRs) that are identical to the CDRs (e.g., VL CDRs) of an antibody set forth in Table 1 and/or Table 2 (e.g., the CDRs are identical to the CDRs of a particular antibody referred to by name in Tables 1 and/or 2).

In certain embodiments, an antibody or fragment thereof, which immunospecifically binds to GITR (e.g., human GITR), comprises: (i) a VL domain comprising VL framework regions having at least 80%, at least 85%, at least 90%, at least 95%, or at least 98% sequence identity to the amino acid sequence of the framework regions selected from the group consisting of SEQ ID NO: 202, 204, 205, 207, and 208; and (ii) a VH domain comprising VH framework regions having at least 80%, at least 85%, at least 90%, at least 95%, or at least 98% sequence identity to the amino acid sequence of the framework regions selected from the group consisting of SEQ ID NO: 201, 203, 206, and 215-389. In a particular embodiment, the antibody comprises VL CDRs that are identical to the VL CDRs of an antibody set forth in Table 3 and/or VH CDRs that are identical to the VH CDRs of an antibody set forth in Table 4.

In certain embodiments, an antibody or fragment thereof, which immunospecifically binds to GITR (e.g., human GITR), comprises a VH domain having at least 80%, at least 85%, at least 90%, at least 95%, or at least 98% sequence identity to the amino acid sequence of the VH domain selected from the group of SEQ ID NO: 201, 203, 206, and 215-389. In certain embodiments, an antibody or fragment thereof, which immunospecifically binds to GITR (e.g., human GITR), comprises a VH domain having at least 80%, at least 85%, at least 90%, at least 95%, or at least 98% sequence identity to the amino acid sequence of the VH domain selected from the group of SEQ ID NO: 201, 203, 206, and 215-389, wherein the antibody or antigen-binding fragment comprises CDRs (e.g., VL CDRs) that are identical to the CDRs (e.g., VL CDRs) of an antibody set forth in Table 1 and/or Table 2 (e.g., the CDRs are identical to the CDRs of a particular antibody referred to in Tables 1 and/or 2).

In certain embodiments, an antibody or fragment thereof, which immunospecifically binds to GITR (e.g., human GITR), comprises a VH domain comprising VH framework regions having at least 80%, at least 85%, at least 90%, at least 95%, or at least 98% sequence identity to the amino acid sequence of the framework regions selected from the group consisting of SEQ ID NO: 201, 203, 206, and 215-389. In a particular embodiment, the antibody comprises VH CDRs that are identical to the VH CDRs of an antibody set forth in Table 2 (e.g., the VH CDRs in one row in Table 2).

In another aspect, provided herein are antibodies that bind the same or an overlapping epitope of GITR (e.g., an epitope of human GITR) as an antibody described herein (e.g., antibody Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107), or antibodies pab2159, pab2160, pab2161, or Hum231#2w. In certain embodiments, the epitope of an antibody can be determined by, e.g., NMR spectroscopy, X-ray diffraction crystallography studies, ELISA assays, hydrogen/deuterium exchange coupled with mass spectrometry (e.g., liquid chromatography electrospray mass spectrometry), array-based oligo-peptide scanning assays, and/or mutagenesis mapping (e.g., site-directed mutagenesis mapping). For X-ray crystallography, crystallization may be accomplished using any of the known methods in the art (e.g., Giegé R et al., (1994) Acta Crystallogr D Biol Crystallogr 50(Pt 4): 339-350; McPherson A (1990) Eur J Biochem 189: 1-23; Chayen N E (1997) Structure 5: 1269-1274; McPherson A (1976) J Biol Chem 251: 6300-6303). Antibody:antigen crystals may be studied using well known X-ray diffraction techniques and may be refined using computer software such as X-PLOR (Yale University, 1992, distributed by Molecular Simulations, Inc.; see e.g. Meth Enzymol (1985) volumes 114 & 115, eds Wyckoff H W et al., U.S. Patent Application No. 2004/0014194), and BUSTER (Bricogne G (1993) Acta Crystallogr D Biol Crystallogr 49(Pt 1): 37-60; Bricogne G (1997) Meth Enzymol 276A: 361-423, ed Carter C W; Roversi P et al., (2000) Acta Crystallogr D Biol Crystallogr 56(Pt 10): 1316-1323). Mutagenesis mapping studies may be accomplished using any method known to one of skill in the art. See, e.g., Champe M et al., (1995) supra and Cunningham B C & Wells J A (1989) supra for a description of mutagenesis techniques, including alanine scanning mutagenesis techniques. In a specific embodiment, the epitope of an antibody or antigen-binding fragment thereof is determined using alanine scanning mutagenesis studies, such as described in Section 6, infra. In addition, antibodies that recognize and bind to the same or overlapping epitopes of GITR (e.g., human GITR) can be identified using routine techniques such as an immunoassay, for example, by showing the ability of one antibody to block the binding of another antibody to a target antigen, i.e., a competitive binding assay. Competition binding assays also can be used to determine whether two antibodies have similar binding specificity for an epitope. Competitive binding can be determined in an assay in which the immunoglobulin under test inhibits specific binding of a reference antibody to a common antigen, such as GITR. Numerous types of competitive binding assays are known, for example: solid phase direct or indirect radioimmunoassay (RIA), solid phase direct or indirect enzyme immunoassay (EIA), sandwich competition assay (see Stahli C et al., (1983) Methods Enzymol 9: 242-253); solid phase direct biotin-avidin EIA (see Kirkland T N et al., (1986) J Immunol 137: 3614-9); solid phase direct labeled assay, solid phase direct labeled sandwich assay (see Harlow E & Lane D, (1988) Antibodies: A Laboratory Manual, Cold Spring Harbor Press); solid phase direct label RIA using 1-125 label (see Morel G A et al., (1988) Mol Immunol 25(1): 7-15); solid phase direct biotin-avidin EIA (Cheung R C et al., (1990) Virology 176: 546-52); and direct labeled RIA. (Moldenhauer G et al., (1990) Scand J Immunol 32: 77-82). Typically, such an assay involves the use of purified antigen (e.g., GITR such as human GITR) bound to a solid surface or cells bearing either of these, an unlabeled test immunoglobulin and a labeled reference immunoglobulin. Competitive inhibition can be measured by determining the amount of label bound to the solid surface or cells in the presence of the test immunoglobulin. Usually the test immunoglobulin is present in excess. Usually, when a competing antibody is present in excess, it will inhibit specific binding of a reference antibody to a common antigen by at least 50-55%, 55-60%, 60-65%, 65-70% 70-75% or more. A competition binding assay can be configured in a large number of different formats using either labeled antigen or labeled antibody. In a common version of this assay, the antigen is immobilized on a 96-well plate. The ability of unlabeled antibodies to block the binding of labeled antibodies to the antigen is then measured using radioactive or enzyme labels. For further details see, for example, Wagener C et al., (1983) J Immunol 130: 2308-2315; Wagener C et al., (1984) J Immunol Methods 68: 269-274; Kuroki M et al., (1990) Cancer Res 50: 4872-4879; Kuroki M et al., (1992) Immunol Invest 21: 523-538; Kuroki M et al., (1992) Hybridoma 11: 391-407 and Antibodies: A Laboratory Manual, Ed Harlow E & Lane D editors supra, pp. 386-389.

In one embodiment, a competition assay is performed using surface plasmon resonance (BIAcore®), e.g., by an 'in tandem approach' such as that described by Abdiche Y N et al., (2009) Analytical Biochem 386: 172-180, whereby GITR antigen is immobilized on the chip surface, for example, a CM5 sensor chip and the anti-GITR antibodies are then run over the chip. To determine if an antibody competes with an anti-GITR antibody or antigen-binding fragment thereof described herein, the anti-GITR antibody is first run over the chip surface to achieve saturation and then the potential, competing antibody is added. Binding of the competing antibody can then be determined and quantified relative to a non-competing control.

In certain aspects, competition binding assays can be used to determine whether an antibody is competitively blocked, e.g., in a dose dependent manner, by another antibody for example, an antibody binds essentially the same epitope, or overlapping epitopes, as a reference antibody, when the two antibodies recognize identical or sterically overlapping epitopes in competition binding assays such as competition ELISA assays, which can be configured in all number of different formats, using either labeled antigen or labeled antibody. In a particular embodiment, an antibody can be tested in competition binding assays with an antibody described herein (e.g., antibody Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, pab2161, or Hum231#2w), or a chimeric or Fab antibody thereof, or an antibody comprising VH CDRs and VL CDRs of an antibody described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, pab2161, or Hum231#2w).

In another aspect, provided herein are antibodies that compete (e.g., in a dose dependent manner) for binding to GITR (e.g., human GITR) with an antibody described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107), or antibodies pab2159, pab2160, pab2161, or Hum231#2w, as determined using assays known to one of skill in the art or described herein (e.g., ELISA competitive assays or surface plasmon resonance). In another aspect, provided herein are antibodies that competitively inhibit (e.g., in a dose dependent manner) an antibody described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, pab2161, or Hum231#2w) from binding to GITR (e.g., human GITR), as determined using assays known to one of skill in the art or described herein (e.g., ELISA competitive assays, or suspension array or surface plasmon resonance assay described in Example 6, infra). In particular embodiments, such competitively blocking antibody activates, induces or enhances one or more GITR activities. In specific aspects, provided herein is an antibody which competes (e.g., in a dose dependent manner) for specific binding to GITR (e.g., human GITR), with an antibody comprising the amino acid sequences described herein (e.g., VL and/or VH amino acid sequences of antibody Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161, or Hum231#2w), as determined using assays known to one of skill in the art or described herein (e.g., ELISA competitive assays, or suspension array or surface plasmon resonance assay described in Example 6, infra).

In certain embodiments, provided herein is an antibody that competes with an antibody described herein for binding to GITR (e.g., human GITR) to the same extent that the antibody described herein self-competes for binding to GITR (e.g., human GITR). In some embodiments, provided herein is a first antibody that competes with an antibody described herein for binding to GITR (e.g., human GITR), wherein the first antibody competes for binding in an assay comprising the following steps: (a) incubating GITR-transfected cells with the first antibody in unlabeled form in a container; and (b) adding an antibody described herein in labeled form in the container and incubating the cells in the container; and (c) detecting the binding of the antibody described herein in labeled form to the cells. In certain embodiments, provided herein is a first antibody that competes with an antibody described herein for binding to GITR (e.g., human GITR), wherein the competition is exhibited as reduced binding of the first antibody to GITR by more than 80% (e.g., 85%, 90%, 95%, or 98%, or between 80% to 85%, 80% to 90%, 85% to 90%, or 85% to 95%).

In specific aspects, provided herein is an antibody which competes (e.g., in a dose dependent manner) for specific binding to GITR (e.g., human GITR), with an antibody comprising a VL domain having the amino acid sequence selected from the group consisting of SEQ ID 202, 207, 208, 400-411, 413-416, 418-421, 423-448, 450-452, 454-464, 467-477, 481-486, 488-513, and 515-518, and a VH domain having the amino acid sequence selected from the group consisting of SEQ ID NO: 201, 206, 215, 217-234, 236-256, 258, 259, 261-265, 267, 268, 271-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 350, 354-356, 358-360, 362-368, 380, 384 and 387. In specific aspects, provided herein is an antibody which competes (e.g., in a dose dependent manner) for specific binding to GITR (e.g., human GITR), with an antibody comprising a VL domain having the amino acid sequence selected from the group consisting of SEQ ID 202, 207, 208, 400-411, 413-416, 418-421, 423-448, 450-452, 454-464, 467-477, 481-486, 488-513, and 515-519, and a VH domain having the amino acid sequence selected from the group consisting of SEQ ID NO: 201, 206, 215, 217-234, 236-256, 258, 259, 261-265, 267, 268, 270-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, and 362-368.

In specific aspects, provided herein is an antibody which competes (e.g., in a dose dependent manner) for specific binding to GITR (e.g., human GITR), with an antibody comprising (i) a VL domain comprising a VL CDR1, VL CDR2, and VL CDR3 having the amino acid sequences of the VL CDRs of an antibody listed in Table 1; and (ii) a VH domain comprising a VH CDR1, VH CDR2, and VH CDR3 having the amino acid sequences of the CDRs of an antibody listed in Table 2 (e.g., the VH CDRs of a particular antibody referred to by name in Table 1, such as 231-32-15, Hum231#1, or Hum231#2).

In a particular embodiment, provided herein is an antibody that competes (e.g., in a dose-dependent manner), for specific binding to GITR (e.g., human GITR), with an antibody comprising the VH and VL CDRs of 231-32-15 (SEQ ID NO: 201 and 202).

In a specific embodiment, an antibody described herein is one that is competitively blocked (e.g., in a dose dependent manner) by an antibody comprising a VL domain having the amino acid sequence selected from the group consisting of SEQ ID NO: 202, 207, 208, 400-411, 413-416, 418-421, 423-448, 450-452, 454-464, 467-477, 481-486, 488-513, and 515-518 and a VH domain having the amino acid sequence selected from the group consisting of SEQ ID NO: 201, 206, 215, 217-234, 236-256, 258, 259, 261-265, 267, 268, 271-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, 362-368, 380, 384, and 387, for specific binding to GITR (e.g., human GITR). In a specific embodiment, an antibody described herein is one that is competitively blocked (e.g., in a dose dependent manner) by an antibody comprising a VL domain having the amino acid sequence selected from the group consisting of SEQ ID NO: 202, 207, 208, 400-411, 413-416, 418-421, 423-448, 450-464, 467-477, 481-486, 488-513, and 515-519 and a VH domain having the amino acid sequence selected from the group consisting of SEQ ID NO: 201, 206, 215, 217-234, 236-256, 258, 259, 261-265, 267, 268, 270-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, and 362-368, for specific binding to GITR (e.g., human GITR).

In one embodiment, an antibody described herein is one that is competitively blocked by an antibody comprising a VL domain having the amino acid sequence of SEQ ID NO: 207 or 208 and a VH domain having the amino acid sequence of SEQ ID NO: 206 for specific binding to GITR (e.g., human GITR).

In another specific embodiment, an antibody described herein is one that is competitively blocked (e.g., in a dose dependent manner) by an antibody comprising (i) a VL domain comprising a VL CDR1, VL CDR2, and VL CDR3 having the amino acid sequences of the CDRs of antibody listed in Table 1 (e.g., the VL CDRs of a particular antibody referred by name in Table 1); and (ii) a VH domain comprising a VH CDR1, VH CDR2, and VH CDR3 having the amino acid sequences of the CDRs of antibody listed in Table 2.

In specific aspects, provided herein is an antibody, or an antigen-binding fragment thereof, which immunospecifically binds to the same epitope as that of an antibody (e.g., any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, pab2161, or Hum231#2w) comprising the amino acid sequences described herein (see, e.g., Tables 1-4) for specific binding to GITR (e.g., human GITR). Assays known to one of skill in the art or described herein (e.g., X-ray crystallography, ELISA assays, etc.) can be used to determine if two antibodies bind to the same epitope.

In a specific embodiment, an antibody or an antigen-binding fragment thereof described herein immunospecifically binds to the same epitope as that of an antibody (e.g., any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107) comprising a VL domain having an amino acid sequence selected from the group consisting of SEQ ID NO: 202, 207, 208, 400-411, 413-416, 418-421, 423-448, 450-452, 454-464, 467-477, 481-486, 488-513, and 515-518, and a VH domain having an amino acid sequence selected from the group consisting of SEQ ID NO: 201, 206, 215, 217-234, 236-256, 258, 259, 261-265, 267, 268, 271-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, 362-368, 380, 384, and 387). In a specific embodiment, an antibody or an antigen-binding fragment thereof described herein immunospecifically binds to the same epitope as that of an antibody (e.g., any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, pab2161, or Hum231#2w) comprising a VL domain having an amino acid sequence selected from the group consisting of SEQ ID NO: 202, 207, 208, 400-411, 413-416, 418-421, 423-448, 450-464, 467-477, 481-486, 488-513, and 515-519, and a VH domain having an amino acid sequence selected from the group consisting of SEQ ID NO: 201, 206, 215, 217-234, 236-256, 258, 259, 261-265, 267, 268, 270-273, 276, 277, 280, 281, 283-285, 287, 288, 290, 291, 294, 296-299, 301, 304-306, 308, 313-316, 319, 320, 322-325, 327, 328, 333, 336, 338-340, 342, 343, 345, 350, 354-356, 358-360, and 362-368).

In a specific embodiment, an antibody or an antigen-binding fragment thereof described herein immunospecifically binds to the same epitope as that bound by an antibody comprising the VH domain and VL domain of antibody Hum231#1 or Hum231#2 (SEQ ID NOs: 206 and 207 or SEQ ID NOs: 206 and 208, respectively), or an epitope that overlaps the epitope of antibody comprising the VH domain and VL domain of antibody Hum231#1 or Hum231#2 (SEQ ID NOs: 206 and 207 or SEQ ID NOs: 206 and 208, respectively).

In another specific embodiment, an antibody or an antigen-binding fragment thereof described herein, immunospecifically binds to the same epitope as that of an antibody comprising (i) a VL domain comprising a VL CDR1, VL CDR2, and VL CDR3 having the amino acid sequences of the CDRs of antibody listed in Table 1 (e.g., the VL CDRs of a particular antibody referred to by name in Table 1) and (ii) a VH domain comprising a VH CDR1, VH CDR2, and VH CDR3 having the amino acid sequences of the CDRs of antibody listed in Table 2 (e.g., the VH CDRs of a particular antibody referred to by name in Table 2).

In a particular embodiment, an antibody described herein or an antigen-binding fragment thereof, which specifically binds to GITR (e.g., human GITR) and competitively blocks (e.g., in a dose dependent manner) antibody 231-32-15, Hum231#1, Hum231#2 or Hum231#2w from binding to GITR (e.g., human GITR), comprises a light chain variable region (VL) and a heavy chain variable region (VH), wherein
(i) the VL comprises:
  (a) a VL CDR1 comprising the amino acid sequence KSSQSX$_1$X$_2$X$_3$X$_4$X$_5$X$_6$X$_7$KX$_8$YLX$_9$ (SEQ ID NO: 4), wherein:
    X$_1$ is L, A, V, I, P, F or M
    X$_2$ is L, A, V, I, P, F, M or S
    X$_3$ is N, G, Q, S, T, C, W, Y or A
    X$_4$ is S, G, N, Q, T, C, W, Y or A
    X$_5$ is G, N, Q, S, T, C, W, Y or A
    X$_6$ is N, G, Q, S, T, C, W, Y or A
    X$_7$ is Q, G, N, S, T, C, W, Y or A
    X$_8$ is N, G, Q, S, T, C, W, Y or A
    X$_9$ is T, G, N, Q, S, C, W, Y, V, I or A; and/or
  (b) a VL CDR2 comprising the amino acid sequence X$_1$ASTRX$_2$X$_3$ (SEQ ID NO: 5), wherein:
    X$_1$ is W, G, N, Q, S, T, C, Y, F, H or A
    X$_2$ is E, D or A
    X$_3$ is S, G, N, Q, T, C, W, Y or A; and/or
  (c) a VL CDR3 comprising the amino acid sequence QX$_1$X$_2$YX$_3$X$_4$PYT (SEQ ID NO: 6), wherein:
    X$_1$ is N, G, Q, S, T, C, W or Y
    X$_2$ is D, E or Y
    X$_3$ is S, G, N, Q, T, C, W, Y or A
    X$_4$ is Y, G, N, Q, S, T, C, W, F, H, L, or A; and (ii) the VH comprises:
  (a) a VH CDR1 comprising the amino acid sequence X$_1$YX$_2$MX$_3$ (SEQ ID NO: 1), wherein
    X$_1$ is D, E, G or A
    X$_2$ is A, V, L, I, P, F, M or Y
    X$_3$ is Y, G, N, Q, S, T, C, W, F or H; and/or
  (b) a VH CDR2 comprising the amino acid sequence X$_1$IX$_2$X$_3$X$_4$SGX$_5$X$_6$X$_7$YX$_8$QKFX$_9$X$_{10}$ (SEQ ID NO: 2), wherein
    X$_1$ is V, A, L, I, P, F, M or T
    X$_2$ is R, K, H, Q or A
    X$_3$ is T, G, N, Q, S, C, W, Y, V, I or P
    X$_4$ is Y, G, N, Q, S, T, C, W, F, H, or A
    X$_5$ is D, E, G or A
    X$_6$ is V, A, L, I, P, F, M or T
    X$_7$ is T, G, N, Q, S, C, W, Y, V, I, P or A
    X$_8$ is N, G, Q, S, T, C, W, Y or A
    X$_9$ is K, R, H, Q or A
    X$_{10}$ is D, E, G or A; and/or
  (c) a VH CDR3 comprising the amino acid sequence SGTVRGX$_1$X$_2$X$_3$ (SEQ ID NO: 3), wherein
    X$_1$ is F, A, V, L, I, P, M, Y, W, H or S
    X$_2$ is A, or D
    X$_3$ is Y, G, N, Q, S, T, C, W, F, H or V.

In a particular embodiment, an antibody described herein, or an antigen-binding fragment thereof, which specifically binds to GITR (e.g., human GITR) and competitively blocks (e.g., in a dose dependent manner) antibody 231-32-15, Hum231#1, Hum231#2 or Hum231#2w from binding to GITR (e.g., human GITR), comprises a light chain variable region (VL) and a heavy chain variable region (VH), wherein
(i) the VL comprises:
  (a) a VL CDR1 comprising the amino acid sequence KSSQSLLNSX$_1$NQKNYLX$_2$ (SEQ ID NO: 10), wherein
    X$_1$ is G or S
    X$_2$ is T or S; and/or
  (b) a VL CDR2 comprising the amino acid sequence WASTRES (SEQ ID NO: 11);
  and/or
  (c) a VL CDR3 comprising the amino acid sequence QNX$_1$YSX$_2$PYT (SEQ ID NO: 12), wherein
    X$_1$ is D or E
    X$_2$ is Y, F or S and (ii) the VH comprises:
  (a) a VH CDR1 comprising the amino acid sequence X$_1$YX$_2$MX$_3$ (SEQ ID NO: 7), wherein
    X$_1$ is D, E or G
    X$_2$ is A or V
    X$_3$ is Y or H; and/or
  (b) a VH CDR2 comprising the amino acid sequence X$_1$IX$_2$TX$_3$SGX$_4$X$_5$X$_6$YNQKFX$_7$X$_8$ (SEQ ID NO: 8), wherein
    X$_1$ is V or L
    X$_2$ is R, K or Q
    X$_3$ is Y or F
    X$_4$ is D, E or G
    X$_5$ is V or L
    X$_6$ is T or S
    X$_7$ is K, R or Q
    X$_8$ is D, E or G; and/or
  (c) a VH CDR3 comprising the amino acid sequence SGTVRGFAY (SEQ ID NO: 9).

In some embodiments, an antibody that competes for binding with an antibody described herein for binding GITR (e.g., human GITR) or binds to the same or an overlapping epitope of an antibody described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, pab2161, or Hum231#2w) prevents binding of GITRL (e.g., human GITRL) to GITR (e.g., human GITR) by less than 85%, 80%, 75%, 70%, 65%, 60%, 55%, 50%, 45%, 40%, 35%, 30%, 25%, 20% or 10% as assessed by an assay known to one of skill in the art or described herein. In a specific embodiment, an antibody or antigen-binding fragment thereof, which competes with an antibody described herein for binding to GITR (e.g., human GITR) or binds to the same epitope or overlapping epitope of an antibody described herein, inhibits binding of GITRL (e.g., human GITRL) to GITR (e.g., human GITR) by less than 85%, 80%, 75%, 70%, 65%, 60%, 55%, 50%, 45%, 40%, 35%, 30%, 25%, 20% or 10% as assessed by the assay described in Example 2, infra (e.g., Section 6.2.5.2 or 6.2.5.4, infra). In another specific embodiment, an antibody or antigen-binding fragment thereof, which competes with an antibody described herein for binding to GITR (e.g., human GITR) or binds to the same epitope or overlapping epitope of an antibody described herein, at a concentration of 1000 ng/ml, 950 ng/ml, 900 ng/ml, 850 ng/ml, 800 ng/ml, 750 ng/ml, 700 ng/ml, 650 ng/ml, 600 ng/ml, 550 ng/ml, 500 ng/ml, 450 ng/ml, 400 ng/ml, 350 ng/ml, 333 ng/ml, 300 ng/ml, 250 ng/ml, 200 ng/ml, 100 ng/ml, 50 ng/ml or 10 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, an antibody or antigen-binding fragment thereof, which competes with an antibody described herein for binding to GITR (e.g., human GITR) or binds to the same epitope or overlapping epitope of an antibody described herein, at concentration of 1000 ng/ml to 750 ng/ml, 1000 ng/ml to 500 ng/ml, 850 ng/ml to 500 ng/ml, 750 ng/ml to 500 ng/ml, 600 ng/ml to 500 ng/ml, 500 ng/ml to 400 ng/ml, 400 ng/ml to 300 ng/ml, or 300 ng/ml to 200 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system).

In another specific embodiment, an antibody or antigen-binding fragment thereof, which competes with an antibody described herein for binding to GITR (e.g., human GITR) or binds to the same epitope or overlapping epitope of an antibody described herein, at concentration of 3500 ng/ml, 3400 ng/ml, 3300 ng/ml, 3200 ng/ml, 3100 ng/ml, 3000 ng/ml, 2900 ng/ml, 2800 ng/ml, 2700 ng/ml, 2600 ng/ml, 2500 ng/ml, 2400 ng/ml, 2300 ng/ml, 2200 ng/ml, 2100 ng/ml, 2000 ng/ml, 1900 ng/ml, 1800 ng/ml, 1700 ng/ml, 1600 ng/ml, 1500 ng/ml, 1400 ng/ml, 1300 ng/ml, 1200 ng/ml, or 1100 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, an antibody or antigen-binding fragment thereof, which competes with an antibody described herein for binding to GITR (e.g., human GITR) or binds to the same epitope or overlapping epitope of an antibody described herein, at concentration of 3500 ng/ml to 3200 ng/ml, 3500 ng/ml to 3000 ng/ml, 3200 ng/ml to 2500 ng/ml, 3000 to 2200 ng/ml, 2500 ng/ml to 1800 ng/ml, 2000 ng/ml to 1500 ng/ml, 1700 ng/ml to 1200 ng/ml, or 1500 ng/ml to 1000 ng/ml inhibits binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., GITRL-PE) to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead by less than 85%, 80%, 75%, 70%, 65%, 60%, 55%, 50%, 45%, 40%, 35%, 30%, 25%, 20% or 10% relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system).

In certain embodiments, an antibody, which competes for binding with an antibody described herein for binding GITR (e.g., human GITR) or binds to the same or an overlapping epitope of an antibody described herein, at a concentration of 3000 ng/ml prevents binding of 0.5 nM GITRL (e.g., human GITRL) to GITR (e.g., human GITR) by less than 85% or less than 80% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 1000 ng/ml prevents binding of 0.5 nM GITRL (e.g., human GITRL) to GITR (e.g., human GITR) by less than 85%, less than 80% or less than 75% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 333 ng/ml prevents binding of 0.5 nM GITRL (e.g., human GITRL) to GITR (e.g., human GITR) by less than 70% or less than 65% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 111 ng/ml prevents binding of 0.5 nM GITRL (e.g., human GITRL) to GITR (e.g., human GITR) by less than 65%, less than 60% or less than 55% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 37 ng/ml prevents binding of 0.5 nM GITRL (e.g., human GITRL) to GITR (e.g., human GITR) by less than 40% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 12 ng/ml prevents binding of 0.5 nM GITRL (e.g., human GITRL) to GITR (e.g., human GITR) by less than 20% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system).

In another embodiment, a certain amount of labeled GITRL (e.g., human GITRL-PE) binds to GITR coupled to beads (e.g., human GITR coupled to Luminex® beads) in the presence of an antibody, which competes for binding with an antibody described herein for binding to GITR or binds to the same or an overlapping epitope of an antibody described herein, in a method comprising: (a) coupling GITR (e.g., human GITR) to beads (e.g., human GITR coupled to Luminex® beads) at a concentration of 5 pg/ml per bead; (b) incubating the GITR coupled beads at a concentration of 40 beads/µl with 3000 ng/ml, 2500 ng/ml, 2000 ng/ml, 1500 ng/ml, 1000 ng/ml, 750 ng/ml, 500 ng/ml, 250 ng/ml, 100 ng/ml, 50 ng/ml or 10 ng/ml of the competing antibody or the antibody that binds to the same or overlapping epitope in a well for a first period of time (e.g., 30 minutes, 60 minutes, 1.5 hours, 2 hours, 2.5 hours or 3 hours), wherein the well contains 700, 750, 800, 850, 900, 950, 1000, 1100, 1200, 1300, 1400 or 1500 beads; (c) adding labeled GITRL (e.g., human GITRL-PE) to the well to obtain a final concentration of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM (in specific embodiments, 0.5 nM) of the labeled GITRL and 20 beads/µl of the GITR coupled beads, and incubating for a second period of time (e.g., 30 minutes, 1 hour, 1.5 hours, 2 hours, 2.5 hours or 3 hours); and (d) detecting the labeled GITRL bound to the GITR coupled beads in, e.g., a suspension array assay such as the Luminex® 200 system. In specific embodiments, the amount of the labeled GITRL bound to the GITR coupled beads in the presence of the competing antibody or the antibody that binds to the same or overlapping epitope is determined relative to the amount of labeled GITRL bound to the GITR coupled beads in the absence of the competing antibody or the antibody that binds to the same or overlapping epitope. In certain embodiments, the absence of the competing antibody or the antibody that binds to the same or overlapping epitope means that no antibody or antigen-binding fragment thereof is present in the well. In other embodiments, the absence of the competing antibody or the antibody that binds to the same or overlapping epitope means that an isotype control antibody that does not bind to GITR is present in the well. In accordance with these embodiments, the amount of labeled GITRL bound to the GITR coupled beads in the presence of the competing antibody or the antibody that binds to the same or overlapping epitope is determined to be, in some embodiments, at least 20%, 25%, 30%, 35%, 40%, 45%, 50%, 55% or 60%, or 20% to 60%, 30% to 50%, or 20% to 70% of the amount of the labeled GITRL bound to the GITR coupled beads in the absence of the competing antibody or the antibody that binds to the same or overlapping epitope.

In certain embodiments, at least 10%, 15%, 20%, 25%, 30%, 35%, 40%, 45%, 50%, 55%, 60%, 65%, 70%, or 75% of GITRL (e.g., human GITRL) binds to GITR (e.g., human GITR) in the presence of an antibody or antigen-binding fragment thereof, which competes with an antibody described herein for binding to GITR (e.g., human GITR) or binds to the same epitope or overlapping epitope of an antibody described herein, assessed by an assay known to one of skill in the art or described herein. In a specific embodiment, at least 10%, 15%, 20%, 25%, 30%, 35%, 40%, 45%, 50%, 55%, 60%, 65%, 70%, or 75% of GITRL (e.g., human GITRL) binds to GITR (e.g., human GITR) in the presence of an antibody or antigen-binding fragment thereof, which competes with an antibody described herein for binding to GITR (e.g., human GITR) or binds to the same epitope or overlapping epitope of an antibody described herein, as assessed by the assay described in Example 2, infra (e.g., Sections 6.2.5.2 or 6.2.5.4, infra). In another specific embodiment, at least 10%, 15%, 20%, 25%, 30%, 35%, 40%, 45%, 50%, 55%, 60%, 65%, 70%, or 75% of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., labeled human GITRL, such as hGITRL-PE) binds to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead in the presence of 1000 ng/ml, 950 ng/ml, 900 ng/ml, 850 ng/ml, 800 ng/ml, 750 ng/ml, 700 ng/ml, 650 ng/ml, 600 ng/ml, 550 ng/ml, 500 ng/ml, 450 ng/ml, 400 ng/ml, 350 ng/ml, 333 ng/ml, 300 ng/ml, 250 ng/ml, 200 ng/ml, 100 ng/ml, 50 ng/ml or 10 ng/ml of an antibody or antigen-binding fragment thereof, which competes with an antibody described herein for binding to GITR (e.g., human GITR) or binds to the same epitope or overlapping epitope of an antibody described herein, relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system). In another specific embodiment, at least 10%, 15%, 20%, 25%, 30%, 35%, 40%, 45%, 50%, 55%, 60%, 65%, 70%, or 75% of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL (e.g., labeled human GITRL, such as hGITRL-PE) binds to GITR coupled to beads (e.g., human GITR coupled to Luminex® beads) at a concentration of 9 pg/ml, 8 pg/ml, 7 pg/ml, 6 pg/ml, 5 pg/ml, 4 pg/ml or 3 pg/ml per bead in the presence of 3500 ng/ml, 3400 ng/ml, 3300 ng/ml, 3200 ng/ml, 3100 ng/ml, 3000 ng/ml, 2900 ng/ml, 2800 ng/ml, 2700 ng/ml, 2600 ng/ml, 2500 ng/ml, 2400 ng/ml, 2300 ng/ml, 2200 ng/ml, 2100 ng/ml, 2000 ng/ml, 1900 ng/ml, 1800 ng/ml, 1700 ng/ml, 1600 ng/ml, 1500 ng/ml, 1400 ng/ml, 1300 ng/ml, 1200 ng/ml, or 1100 ng/ml of an antibody or antigen-binding fragment thereof, which competes with an antibody described herein for binding to GITR (e.g., human GITR) or binds to the same epitope or overlapping epitope of an antibody described herein, relative to the binding of 1.5 nM, 1.4 nM, 1.3 nM, 1.2 nM, 1.1 nM, 1 nM, 0.9 nM, 0.8 nM, 0.7 nM, 0.6 nM, 0.5 nM, 0.4 nM, 0.3 nM, 0.2 nM or 0.1 nM of labeled GITRL to the GITR coupled beads at a concentration of 9 pg/ml, 8 pg/ml, 7 pg/ml, 6 pg/ml, 5 pg/ml, 4 pg/ml or 3 pg/ml per bead in the absence of the anti-GITR antibody or antigen-binding fragment thereof in a suspension array assay (e.g., Luminex® 200 system).

In certain embodiments, an antibody, which competes for binding with an antibody described herein for binding GITR (e.g., human GITR) or binds to the same or an overlapping epitope of an antibody described herein, at a concentration of 3000 ng/ml does not prevent binding of 0.5 nM GITRL (e.g., human GITRL) to GITR (e.g., human GITR) by more than 15% or more than 20% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 1000 ng/ml does not prevent binding of 0.5 nM GITRL (e.g., human GITRL) to GITR (e.g., human GITR) by more than 15%, more than 20% or more than 25% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 333 ng/ml does not prevent binding of 0.5 nM GITRL (e.g., human GITRL) to GITR (e.g., human GITR) by more than 30% or more than 35% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 111 ng/ml does not prevent binding of 0.5 nM GITRL (e.g., human GITRL) to GITR (e.g., human GITR) by more than 35%, more than 40% or more than 45% when GITR (e.g., human GITR) is coupled to beads (e.g., Luminex® beads) at a concentration of 5 pg/ml per bead relative to the binding of 0.5 nM of labeled GITRL to GITR coupled beads at a concentration of 5 pg/ml/bead in the absence of the anti-GITR antibody or antigen-binding fragment thereof in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 37 ng/ml does not prevent binding of 0.5 nM GITRL (e.g., human GITRL) to GITR (e.g., human GITR) by more than 60% when GITR (e.g., human GITR) is coupled to beads (e.g., Luminex® beads) at a concentration of 5 pg/ml relative to the binding of 0.5 nM of labeled GITRL to GITR coupled beads at a concentration of 5 pg/ml/bead in the absence of the anti-GITR antibody or antigen-binding fragment thereof per bead in a suspension array assay (e.g., Luminex® 200 system). In certain embodiments, an antibody, which competes for binding with an antibody described herein for binding GITR (e.g., human GITR) or binds to the same or an overlapping epitope of an antibody described herein, at a concentration of 12 ng/ml does not prevent binding of 0.5 nM GITRL (e.g., human GITRL) to GITR (e.g., human GITR) by more than 85% when GITR (e.g., human GITR) is coupled to beads (e.g., Luminex® beads) at a concentration of 5 pg/ml relative to the binding of 0.5 nM of labeled GITRL to GITR coupled beads at a concentration of 5 pg/ml/bead in the absence of the anti-GITR antibody or antigen-binding fragment thereof per bead in a suspension array assay (e.g., Luminex® 200 system).

In certain embodiments, provided herein is an antibody, which competes for binding with an antibody described herein for binding GITR (e.g., human GITR) or binds to the same or an overlapping epitope of an antibody described herein, at a concentration of 150 nM, 145 nM, 140 nM, 135 nM, 130 nM, 125 nM, 120 nM, 115 nM, 110 nM, 105 nM or 100 nM bound to GITR (e.g., human GITR) immobilized on a chip (e.g., CM5 sensor chip) inhibits binding of 150 nM, 145 nM, 140 nM, 135 nM, 130 nM, 125 nM, 120 nM, 115 nM, 110 nM, 105 nM or 100 nM of GITRL (e.g., non-covalently linked trimer of human GITRL) to the GITR immobilized on the chip by less than 60%, less than 55%, less than 50%, less than 45%, less than 40%, less than 35%, less than 30%, less than 25%, less than 20% or less than 15%. In certain embodiments, provided herein is an antibody, which competes for binding with an antibody described herein for binding GITR (e.g., human GITR) or binds to the same or an overlapping epitope of an antibody described herein, wherein the competing antibody or the antibody that binds to the same or overlapping epitope at a concentration of 125 nM bound to GITR (e.g., human GITR) immobilized on a chip (e.g., CM5 sensor chip) inhibits binding of 125 nM of GITRL (e.g., non-covalently linked trimer of human GITRL) to the GITR immobilized on the chip by less than 60%, less than 55%, less than 50%, less than 45%, less than 40%, less than 35%, less than 30%, less than 25%, less than 20% or less than 15%.

In certain embodiments, an antibody or fragment thereof, which competes with an antibody described herein for binding to GITR (e.g., human GITR) or binds to the same epitope or overlapping epitope of an antibody described herein, binds to GITR (e.g., human GITR) with a dissociation rate constant ($k_{off}$) of $8.5 \times 10^{-3}$ $s^{-1}$ or less, $3.5 \times 10^{-3}$ $s^{-1}$ or less, $5 \times 10^{-3}$ $s^{-1}$ or less, $2.5 \times 10^{-3}$ $s^{-1}$ or less, $1 \times 10^{-3}$ $s^{-1}$ or less, $8.5 \times 10^{-4}$ $s^{-1}$ or less, $5 \times 10^{-4}$ $s^{-1}$ or less, $3.5 \times 10^{-4}$ $s^{-1}$ or less, $2.5 \times 10^{-4}$ $s^{-1}$ or less, $1 \times 10^{-4}$ $s^{-1}$ or less, $8.5 \times 10^{-5}$ $s^{-1}$ or less, $3.5 \times 10^{-5}$ $s^{-1}$ or less, $5 \times 10^{-5}$ $s^{-1}$ or less, $2.5 \times 10^{-5}$ $s^{-1}$ or less, $1 \times 10^{-5}$ $s^{-1}$ or less, $8.5 \times 10^{-6}$ $s^{-1}$ or less, $5 \times 10^{-6}$ $s^{-1}$ or less, $3.5 \times 10^{-6}$ $s^{-1}$ or less, $2.5 \times 10^{-6}$ $s^{-1}$ or less, $1 \times 10^{-6}$ $s^{-1}$ or less, $8.5 \times 10^{-7}$ $s^{-1}$ or less, $5 \times 10^{-7}$ $s^{-1}$ or less, $2.5 \times 10^{-7}$ $s^{-1}$ or less, $1 \times 10^{-7}$ $s^{-1}$ or less, $8.5 \times 10^{-8}$ $s^{-1}$ or less, $5 \times 10^{-8}$ $s^{-1}$ or less, $2.5 \times 10^{-8}$ $s^{-1}$ or less, $1 \times 10^{-8}$ $s^{-1}$ or less, $8.5 \times 10^{-9}$ $s^{-1}$ or less, $5 \times 10^{-9}$ $s^{-1}$ or less, $2.5 \times 10^{-9}$ $s^{-1}$ or less, or $1\times10^{-9-}$ $s^{-1}$ or less. In some embodiments, an antibody or fragment thereof, which competes with an antibody described herein for binding to GITR (e.g., human GITR) or binds to the same epitope or overlapping epitope of an antibody described herein, binds to GITR (e.g., human GITR) with a $k_{off}$ of between $9.5\times10^{-5-}$ $s^{-1}$ to $1\times10^{-9-}$ $s^{-1}$, $8.5\times10^{-5-}$ $s^{-1}$ to $1\times10^{-9-}$ $s^{-1}$, $5\times10^{-5-}$ $s^{-1}$ to $1\times10^{-9-}$ $s^{-1}$, $9.5\times10^{-5-}$ $s^{-1}$ to $1\times10^{-8-}$ $s^{-1}$, $5\times10^{-5-}$ $s^{-1}$ to $1\times10^{-8-}$ $s^{-1}$, $9.5\times10^{-5-}$ $s^{-1}$ to $1\times10^{-7-}$ $s^{-1}$, $5\times10^{-5-}$ $s^{-1}$ to $1\times10^{-7-}$ $s^{-1}$, $9.5\times10^{-5-}$ $s^{-1}$ to $5\times10^{-6-}$ $s^{-1}$, $9.5\times10^{-5-}$ $s^{-1}$ to $1\times10^{-5-}$ $s^{-1}$, $8.5\times10^{-3}$ $s^{-1}$ to $1\times10^{-4}$ $s^{-1}$, $5\times10^{-3}$ $s^{-1}$ to $2.5\times10^{-4}$ $s^{-1}$, $8.5\times10^{-3}$ $s^{-1}$, to $1\times10^{-5}$ $s^{-1}$, $8.5\times10^{-5-}$ $s^{-1}$ to $5\times10^{-5-}$ $s^{-1}$. In certain embodiments, the $k_{off}$ is determined using a monovalent antibody, such as a Fab fragment, as measured by, e.g., BIAcore® surface plasmon resonance technology. In other embodiments, the $k_{off}$ is determined using a bivalent antibody as measured by, e.g., BIAcore® surface plasmon resonance technology. In a particular embodiment, the $k_{off}$ is determined using an assay described in Section 6, infra.

In certain embodiments, an antibody or fragment thereof, which competes with an antibody described herein for binding to GITR (e.g., human GITR) or binds to the same epitope or overlapping epitope of an antibody described herein, binds to GITR (e.g., human GITR) with an association rate constant $k_{on}$ of at least $10^5$ $M^{-1}$ $s^{-1}$, at least $2.5\times10^5$ $M^{-1}$ $s^{-1}$, at least $3.5\times10^5$ $M^{-1}s^{-1}$, at least $5\times10^5$ $M^{-1}s^{-1}$, at least $10^6$ $M^{-1}s^{-1}$, at least $2.5\times10^6$ $M^{-1}s^{-1}$, at least $3.5\times10^6$ $M^{-1}s^{-1}$, at least $5\times10^6$ $M^{-1}s^{-1}$, at least $10^7$ $M^{-1}s^{-1}$, at least $5\times10^7$ $M^{-1}s^{-1}$, at least $10^8$ $M^{-1}s^{-1}$, at least $5\ 10^8$ $M^{-1}s^{-1}$ or at least $10^9$ $M^{-1}s^{-1}$. In some embodiments, an antibody or fragment thereof, which competes with an antibody described herein for binding to GITR (e.g., human GITR) or binds to the same epitope or overlapping epitope of an antibody described herein, binds to GITR (e.g., human GITR) with a $k_{on}$ of between $1\times10^5$ $M^{-1}s^{-1}$ to $5\times10^5$ $M^{-1}$ $s^{-1}$, $1\times10^5$ $M^{-1}s^{-1}$ to $1\times10^6$ $M^{-1}s^{-1}$, $3.5\times10^5$ $M^{-1}$ $s^{-1}$ to $2.5\times10^6$ $M^{-1}$ $s^{-1}$, $3.5\times10^5$ $M^{-1}$ $s^{-1}$ to $3.5\times10^6$ $M^{-1}s^{-1}$, $1\times10^5$ $M^{-1}$ $s^{-1}$ to $5\times10^6$ $M^{-1}s^{-1}$, $1\times10^5$ $M^{-1}$ $s^{-1}$ to $1\times10^7$ $M^{-1}$ $s^{-1}$, $1\times10^5$ $M^{-1}s^{-1}$ to $5\times10^7$ $M^{-1}s^{-1}$, $1\times10^5$ $M^{-1}$ $s^{-1}$ to $10^8$ $M^{-1}$ $s^{-1}$, $1\times10^5 M^{-1}s^{-1}$ to $1\times10^9$ $M^{-1}$ $s^{-1}$, $1\times10^6 M^{-1}s^{-1}$ to $1\times10^7$ $M^{-1}$ $s^{-1}$, $1\times10^6$ $M^{-1}s^{-1}$ to $1\times10^8$ $M^{-1}s^{-1}$, $1\times10^6$ $M^{-1}s^{-1}$ to $1\times10^9$ $M^{-1}s^{-1}$, $1\times10^7$ $M^{-1}s^{-1}$ to $1\times10^8$ $M^{-1}s^{-1}$, $1\times10^7$ $M^{-1}s^{-1}$ to $1\times10^9$ $M^{-1}s^{-1}$, $1\times10^8 M^{-1}$ $s^{-1}$ to $1\times10^9$ $M^{-1}s^{-1}$. In certain embodiments, the $k_{on}$ is determined using a monovalent antibody, such as a Fab fragment, as measured by, e.g., BIAcore® surface plasmon resonance technology. In other embodiments, the $k_{on}$ is determined using a bivalent antibody as measured by, e.g., BIAcore® surface plasmon resonance technology. In a particular embodiment, the $k_{on}$ is determined using an assay described in Section 6, infra.

In certain embodiments, an antibody or fragment thereof, which competes with an antibody described herein for binding to GITR (e.g., human GITR) or binds to the same epitope or overlapping epitope of an antibody described herein, binds to GITR (e.g., human GITR) with a $K_D$ of less than 7 nM, 6 nM, 5 nM, 4.5 nM, 4 nM, 3.5 nM, 3 nM, 2.5 nM, 2 nM, 1.5 nM, 1 nM, 0.75 nM, 0.5 nM, 0.25 nM, or 0.1 nM. In some embodiments, an antibody or fragment thereof, which competes with an antibody described herein for binding to GITR (e.g., human GITR) or binds to the same epitope or overlapping epitope of an antibody described herein, binds to GITR (e.g., human GITR) with a $K_D$ of about 7 nM, 6 nM, 5 nM, 4.5 nM, 4 nM, 3.5 nM, 3 nM, 2.5 nM, 2 nM, 1.5 nM, 1 nM, 0.75 nM, 0.5 nM, 0.25 nM, or 0.1 nM. In certain embodiments, an antibody or fragment thereof described herein, which competes with an antibody described herein for binding to GITR (e.g., human GITR) or binds to the same epitope or overlapping epitope of an antibody described herein, binds to GITR (e.g., human GITR) with a $K_D$ of 7 nM to 4 nM, 7 nM to 5 nM, 6 nM to 4 nM, 5 nM to 3 nM, 5 nM to 1 nM, 5 nM to 0.5 nM, 4 nM to 3 nM, 4 nM to 2 nM, 4 nM to 1 nM, 4 nM to 0.5 nM, 3 nM to 2 nM, 3 nM to 1 nM, 3 nM to 0.5 nM, 2 nM to 1 nM, 2 nM to 0.5 nM, 3 nM to 0.1 nM, 2 nM to 0.1 nM, 1 nM to 0.1 nM, or 0.5 nM to 0.1 nM. In certain embodiments, the $K_D$ is calculated as the quotient of $k_{off}/k_{on}$, and the $k_{on}$ and $k_{off}$ are determined using a monovalent antibody, such as a Fab fragment, as measured by, e.g., BIAcore® surface plasmon resonance technology. In other embodiments, the $K_D$ is calculated as the quotient of $k_{off}/k_{on}$, and the $k_{on}$ and $k_{off}$ are determined using a bivalent antibody, such as a Fab fragment, as measured by, e.g., BIAcore® surface plasmon resonance technology. In a specific embodiment, the $K_D$ is determined as set forth in the Examples in Section 6, infra (e.g., Example 2).

In certain embodiments, the epitope of an antibody described herein is used as an immunogen to produce antibodies. See, e.g., Section 5.2 infra for methods for producing antibodies.

In specific aspects, an antibody or fragment thereof described, which specifically binds to GITR (e.g., human GITR), does not inhibit (e.g., in a dose dependent manner) the binding of the murine antibody 6C8 to GITR (e.g., human GITR) in an assay known to one of skill in the art or described herein. See, e.g., U.S. Pat. No. 7,812,135 for a description of the murine antibody 6C8. In certain embodiments, at least 20%, 25%, 30%, 35%, 40%, 45%, 50%, 55%, 60%, 65%, 70%, 75%, 80%, 85%, 90%, 95% or more of the murine antibody 6C8 binds to GITR (e.g., human GITR) in the presence of an antibody or fragment thereof described, which specifically binds to GITR (e.g., human GITR), as assessed in an assay known to one of skill in the art or described herein. In a specific embodiment, an antibody or fragment thereof described, which specifically binds to GITR (e.g., human GITR), does not inhibit (e.g., in a dose dependent manner) the binding of the murine antibody 6C8 to GITR (e.g., human GITR) as assessed in the assay described in Example 6, infra. In certain embodiments, at least 20%, 25%, 30%, 35%, 40%, 45%, 50%, 55%, 60%, 65%, 70%, 75%, 80%, 85%, 90%, 95% or more of the murine antibody 6C8 binds to GITR (e.g., human GITR) in the presence of an antibody or fragment thereof described, which specifically binds to GITR (e.g., human GITR), as assessed in the assay described in Example 6, infra.

In some embodiments, anti-GITR antibodies described herein may be multispecific antibodies, e.g., bispecific antibodies. In a particular embodiment, an anti-GITR antibody described herein is a bispecific antibody, wherein the antibody has specificities for at least two different, typically non-overlapping epitopes. In a particular embodiment, a bispecific antibody comprises one arm comprising of an antibody described herein with specificity for GITR (e.g., human GITR), and a second arm comprising an antibody with specificity for a different epitope on GITR (e.g., human GITR) or an epitope on a different molecule, e.g., PD-1, PD-L1, PD-L2, CTLA-4, TIM-3, LAG-3 or OX40. For example, the bispecific antibody may comprise one arm comprising an antibody described herein with specificity for GITR (e.g., human GITR) and a second arm comprising an antibody with specificity for CTLA-4, such as tremelimumab (Pfizer), ipilimumab (Yervoy®, Bristol-Meyers Squibb), an antibody that binds to the same epitope as tremelimumab or an overlapping epitope thereto, or an antibody that binds to the same epitope as ipilimumab or an overlapping epitope thereto.

In specific aspects, an antibody or fragment thereof described herein, which immunospecifically binds to GITR (e.g., human GITR), functions as an agonist.

In certain embodiments, an antibody or fragment thereof described herein, which immunospecifically binds to GITR (e.g., human GITR), increases GITR (e.g., human GITR) activity by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold as assessed by methods described herein and/or known to one of skill in the art, relative to GITR (e.g., human GITR) activity in the presence or absence of GITRL (e.g., human GITRL) stimulation without any antibody or with an unrelated antibody (e.g., an antibody that does not immunospecifically bind to GITR). In certain embodiments, an antibody or fragment thereof described herein, which immunospecifically binds to GITR (e.g., human GITR), increases GITR (e.g., human GITR) activity by at least 5%, 10%, 15%, 20%, 25%, 30%, 35%, 40%, 45%, 50%, 55%, 60%, 65%, 70%, 75%, 80%, 85%, 90%, 95%, 98%, or 99% as assessed by methods described herein and/or known to one of skill in the art, relative to GITR (e.g., human GITR) activity in the presence or absence of GITRL (e.g., human GITRL) stimulation without any antibody or with an unrelated antibody (e.g., an antibody that does not immunospecifically bind to GITR). Non-limiting examples of GITR (e.g., human GITR) activity can include cell proliferation, GITR (e.g., human GITR) signaling, cell survival, and cytokine production (e.g., IL-2, IL-6, IL-10, TNF-α, and IFN-γ). In specific embodiments, an antibody or fragment thereof described herein, which immunospecifically binds to GITR (e.g., human GITR), induces or increases a GITR (e.g., human GITR) activity together with GITRL (e.g., human GITRL). In certain embodiments, an antibody or fragment thereof described herein, which immunospecifically binds to GITR (e.g., human GITR), induces, enhances, or increases a GITR (e.g., human GITR) activity in the absence of GITRL (e.g., human GITRL). In specific embodiments, the antibody or antibody-binding fragment induces, enhances, or increases a GITR activity and does not inhibit (e.g., does not completely inhibit or only partially inhibits) GITRL from binding to GITR. In specific embodiments, an increase in a GITR activity is assessed as described in the Examples, infra.

In certain aspects, an antibody or fragment thereof described herein, which immunospecifically binds to GITR (e.g., human GITR), induces, enhances, or increases the cellular proliferation of cells that express GITR and that respond to GITR signaling (e.g., cells that proliferate in response to GITR stimulation and GITR signaling, such as T cells). Cell proliferation assays are described in the art, such as a $^3$H-thymidine incorporation assay, BrdU incorporation assay or CFSE assay, such as described in Example 3, and can be readily carried out by one of skill in the art. In specific embodiments, T cells (e.g., CD4$^+$ or CD8$^+$ effector T cells) stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cellular proliferation relative to T cells only stimulated with the T cell mitogen or T cell receptor complex stimulating agent phytohaemagglutinin (PHA) and/or phorbol myristate acetate (PMA), or a TCR complex stimulating antibody, such as an anti-CD3 antibody and anti-CD28 antibody). See Example 3, infra, which demonstrates an increase in T cell proliferation in the presence of an antibody described herein that immunospecifically binds to GITR.

In one embodiment, CD8$^+$ T cells stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cellular proliferation relative to T cells only stimulated with the T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody). In another embodiment, CD4$^+$ T cells stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cellular proliferation relative to T cells only stimulated with the T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody). In another embodiment, CD4$^+$ T cells and CD8$^+$ T cells stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cellular proliferation relative to T cells only stimulated with the T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody). In some embodiments, T cells that have not been stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR) have increased GITR activity and/or increased NF-κB activity relative to T cells not in the presence of an antibody or fragment thereof described herein, which immunospecifically binds to GITR (e.g., human GITR).

In specific embodiments, an antibody or fragment thereof described herein, which immunospecifically binds to GITR (e.g., human GITR), increases cell proliferation (e.g., T cells, such as CD4 and CD8 effector T cells) by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold, as assessed by methods described herein or known to one of skill in the art (e.g., $^3$H-thymidine incorporation assay, BrdU incorporation assay or CFSE assay, such as described in Example 3, infra), relative to GITR (e.g., human GITR) activity in the presence or absence of GITRL (e.g., human GITRL) stimulation without any antibody or with an unrelated antibody (e.g., an antibody that does not immunospecifically bind to GITR). In specific embodiments, an antibody or fragment thereof described herein, which immunospecifically binds to GITR (e.g., human GITR), increases cell proliferation (e.g., T cells, such as CD4 and CD8 effector T cells) by at least at least about 5%, 10%, 15%, 20%, 25%, 30%, 35%, 40%, 45%, 50%, 55%, 60%, 65%, 70%, 75%, 80%, 85%, 90%, 95%, 98%, or 99%, as assessed by methods described herein or known to one of skill in the art (e.g., $^3$H-thymidine incorporation assay, BrdU incorporation assay or CFSE assay, such as described in Example 3, infra), relative to GITR (e.g., human GITR) activity in the presence or absence of GITRL (e.g., human GITRL) stimulation without any antibody or with an unrelated antibody (e.g., an antibody that does not immunospecifically bind to GITR).

In some embodiments, T cells (e.g., CD4$^+$ or CD8$^+$ effector T cells) stimulated with a T cell mitogen (e.g., an anti-CD3 antibody or phorbol ester) in the presence of an antibody or fragment thereof described herein, which immunospecifically binds to GITR (e.g., human GITR), have increased cellular proliferation by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold relative to T cells only stimulated with the T cell mitogen, as assessed by methods described herein or known to one of skill in the art (e.g., $^3$H-thymidine incorporation assay, BrdU incorporation assay or CFSE assay, such as described in Example 3, infra). In some embodiments, T cells (e.g., CD4$^+$ or CD8$^+$ effector T cells) stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cellular proliferation by at least about 5%, 10%, 15%, 20%, 25%, 30%, 35%, 40%, 45%, 50%, 55%, 60%, 65%, 70%, 75%, 80%, 85%, 90%, 95%, 98%, or 99% relative to T cells only stimulated with the T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody), as assessed by methods described herein or known to one of skill in the art (e.g., $^3$H-thymidine incorporation assay, BrdU incorporation assay or CFSE assay, such as described in Example 3, infra). In a specific embodiment, cell proliferation is assessed as described in Example 3, infra.

In certain aspects, an antibody or fragment thereof described herein, which immunospecifically binds to GITR (e.g., human GITR), increases the survival of cells (e.g., T cells, such as CD4 and CD8 effector T cells). In a specific embodiment, T cells (e.g., CD4$^+$ or CD8$^+$ effector T cells) stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased survival relative to T cells only stimulated with the T cell mitogen. Cell survival assays are described in the art (e.g., a trypan blue exclusion assay) and can be readily carried out by one of skill in the art.

In specific embodiments, an antibody or fragment thereof described herein, which immunospecifically binds to GITR (e.g., human GITR), increases cell survival (e.g., T cells, such as CD4 and CD8 effector T cells) by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold, as assessed by methods described herein or known to one of skill in the art (e.g., a trypan blue exclusion assay), relative to cell survival in the presence or absence of GITRL (e.g., human GITRL) stimulation without any antibody or with an unrelated antibody (e.g., an antibody that does not immunospecifically bind to GITR). In specific embodiments, an antibody or fragment thereof described herein, which immunospecifically binds to GITR (e.g., human GITR), increases cell survival (e.g., T cells, such as CD4 and CD8 effector T cells) by at least about 5%, 10%, 15%, 20%, 25%, 30%, 35%, 40%, 45%, 50%, 55%, 60%, 65%, 70%, 75%, 80%, 85%, 90%, 95%, 98%, or 99%, as assessed by methods described herein or known to one of skill in the art (e.g., a trypan blue exclusion assay), relative to cell survival in the presence or absence of GITRL (e.g., human GITRL) stimulation without any antibody or with an unrelated antibody (e.g., an antibody that does not immunospecifically bind to GITR).

In some embodiments, T cells (e.g., CD4$^+$ or CD8$^+$ effector T cells) stimulated with a T cell mitogen (e.g., an anti-CD3 antibody or phorbol ester) in the presence of an antibody or fragment thereof described herein, which immunospecifically binds to GITR (e.g., human GITR), have increased cell survival by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold relative to T cells only stimulated with the T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody), as assessed by methods described herein or known to one of skill in the art (e.g., a trypan blue exclusion assay). In some embodiments, T cells (e.g., CD4$^+$ or CD8$^+$ effector T cells) stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cell survival by at least about 5%, 10%, 15%, 20%, 25%, 30%, 35%, 40%, 45%, 50%, 55%, 60%, 65%, 70%, 75%, 80%, 85%, 90%, 95%, 98%, or 99% relative to T cells only stimulated with the T cell mitogen, as assessed by methods described herein or known to one of skill in the art (e.g., a trypan blue exclusion assay).

In certain embodiments, an antibody or fragment thereof described herein, which immunospecifically binds to GITR (e.g., human GITR), protects effector T cells (e.g., CD4$^+$ and CD8$^+$ effector T cells) from activation-induced cell death. In some embodiments, an antibody or fragment thereof described herein, which immunospecifically binds to GITR (e.g., human GITR), induces resistance of effector T cells (e.g., CD4$^+$ and CD8$^+$ effector T cells) to Treg-mediated suppression.

In specific embodiments, an antibody or fragment thereof described herein, which immunospecifically binds to GITR (e.g., human GITR), induces, enhances, or increases cytokine production (e.g., IL-2, IL-6, IL-10, TNF-α, and IFN-γ) by at least about 5%, 10%, 15%, 20%, 25%, 30%, 35%, 40%, 45%, 50%, 55%, 60%, 65%, 70%, 75%, 80%, 85%, 90%, 95%, 98%, or 99%, as assessed by methods described herein (see the Examples, infra, such as Example 3) or known to one of skill in the art, relative to cytokine production in the presence or absence of GITRL (e.g., human GITRL) stimulation without any antibody or with an unrelated antibody (e.g., an antibody that does not immunospecifically bind to GITR). In specific embodiments, an antibody or fragment thereof described herein, which immunospecifically binds to GITR (e.g., human GITR), induces or enhances cytokine production (e.g., IL-2, IL-6, IL-10, TNF-α, and IFN-γ) by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold, as assessed by methods described herein (see the Examples, infra, such as Example 3) or known to one of skill in the art, relative to cytokine production in the presence or absence of GITRL (e.g., human GITRL) stimulation without any antibody or with an unrelated antibody (e.g., an antibody that does not immunospecifically bind to GITR).

In certain embodiments, T cells (e.g., CD4$^+$ or CD8$^+$ effector T cells) stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cytokine production (e.g., IL-2, IL-6, IL-10, TNF-α, and IFN-γ) by at least about 5%, 10%, 15%, 20%, 25%, 30%, 35%, 40%, 45%, 50%, 55%, 60%, 65%, 70%, 75%, 80%, 85%, 90%, 95%, 98%, or 99% relative to T cells only stimulated with the T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody), as assessed by methods described herein or known to one of skill in the art (e.g., an ELISA assay or as described in the Examples, infra). In some embodiments, T cells (e.g., CD4$^+$ or CD8$^+$ effector T cells) stimulated with a T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody) in the presence of an antibody or fragment thereof described herein, which immunospecifically binds to GITR (e.g., human GITR), have increased cytokine production (e.g., IL-2, IL-6, IL-10, TNF-α, and IFN-γ) by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, or 100 fold relative to T cells only stimulated with the T cell mitogen or T cell receptor complex stimulating agent (e.g., phytohaemagglutinin (PHA) and/or phorbol myristate acetate (PMA), or a TCR complex stimulating antibody, such as an anti-CD3 antibody and anti-CD28 antibody), as assessed by methods described herein or known to one of skill in the art (e.g., an ELISA assay or as described in the Examples, infra).

In certain embodiments, an anti-GITR antibody or antigen binding fragment thereof induces, enhances or activates an activity of GITR, in the absence of a TCR agonist (e.g., an anti-CD3 antibody). GITR activity can be assessed by measuring activation of canonical and non-canonical NF-κB pathways. GITR activity can be assessed by measuring activation of TRAF adapter mediated signaling pathways. The TRAF adapter is selected from the group consisting of TRAF1, TRAF2, TRAF3, TRAF4, and TRAF5. GITR activity can be assessed by measuring activation of MAPK/ERK pathway (also called the Ras-Raf-MEK-ERK pathway). Examples of "a TCR agonist" include, but are not limited to, antibodies targeting the T cell receptor complex (e.g., an anti-CD3 antibody) and peptides bound to human leukocyte antigens, e.g., MHC class I and MHC class II, wherein the peptides are derived from self, mutated self, or pathogen associated proteins (e.g., viral or bacterial).

An anti-GITR antibody or antigen-binding fragment thereof can be fused or conjugated (e.g., covalently or noncovalently linked) to a detectable label or substance. Examples of detectable labels or substances include enzyme labels, such as, glucose oxidase; radioisotopes, such as iodine ($^{125}$I, $^{121}$I), carbon ($^{14}$C), sulfur ($^{35}$S), tritium ($^3$H), indium ($^{121}$In), and technetium ($^{99}$Tc); luminescent labels, such as luminol; and fluorescent labels, such as fluorescein and rhodamine, and biotin. Such labeled antibodies or antigen-binding fragments can be used to detect GITR (e.g., human GITR) protein. See, e.g., Section 5.4.2, infra.

5.2 Antibody Production

Antibodies or fragments thereof that immunospecifically bind to GITR (e.g., human GITR) can be produced by any method known in the art for the synthesis of antibodies, for example, by chemical synthesis or by recombinant expression techniques. The methods described herein employs, unless otherwise indicated, conventional techniques in molecular biology, microbiology, genetic analysis, recombinant DNA, organic chemistry, biochemistry, PCR, oligonucleotide synthesis and modification, nucleic acid hybridization, and related fields within the skill of the art. These techniques are described, for example, in the references cited herein and are fully explained in the literature. See, e.g., Maniatis T et al., (1982) Molecular Cloning: A Laboratory Manual, Cold Spring Harbor Laboratory Press; Sambrook J et al., (1989), Molecular Cloning: A Laboratory Manual, Second Edition, Cold Spring Harbor Laboratory Press; Sambrook J et al., (2001) Molecular Cloning: A Laboratory Manual, Cold Spring Harbor Laboratory Press, Cold Spring Harbor, N.Y.; Ausubel F M et al., Current Protocols in Molecular Biology, John Wiley & Sons (1987 and annual updates); Current Protocols in Immunology, John Wiley & Sons (1987 and annual updates) Gait (ed.) (1984) Oligonucleotide Synthesis: A Practical Approach, IRL Press; Eckstein (ed.) (1991) Oligonucleotides and Analogues: A Practical Approach, IRL Press; Birren B et al., (eds.) (1999) Genome Analysis: A Laboratory Manual, Cold Spring Harbor Laboratory Press.

In a specific embodiment, an antibody described herein is an antibody (e.g., recombinant antibody) prepared, expressed, created or isolated by any means that involves creation, e.g., via synthesis, genetic engineering of DNA sequences. In certain embodiments, such antibody comprises sequences (e.g., DNA sequences or amino acid sequences) that do not naturally exist within the antibody germline repertoire of an animal or mammal (e.g., human) in vivo.

In a certain aspect, provided herein is a method of making an antibody or an antigen-binding fragment thereof which immunospecifically binds to GITR (e.g., human GITR) comprising culturing a cell or host cell described herein. In a certain aspect, provided herein is a method of making an antibody or an antigen-binding fragment thereof which immunospecifically binds to GITR (e.g., human GITR) comprising expressing (e.g., recombinantly expressing) the antibody or antigen-binding fragment thereof using a cell or host cell described herein (e.g., a cell or a host cell comprising polynucleotides encoding an antibody described herein). In a particular embodiment, the cell is an isolated cell. In a particular embodiment, the exogenous polynucleotides have been introduced into the cell. In a particular embodiment, the method further comprises the step of purifying the antibody or antigen-binding fragment thereof obtained from the cell or host cell.

Methods for producing polyclonal antibodies are known in the art (see, for example, Chapter 11 in: Short Protocols in Molecular Biology, (2002) 5th Ed., Ausubel F M et al., eds., John Wiley and Sons, New York).

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow E & Lane D, Antibodies: A Laboratory Manual, (Cold Spring Harbor Laboratory Press, 2nd ed. 1988); Hammerling G J et al., in: Monoclonal Antibodies and T-Cell Hybridomas 563 681 (Elsevier, N.Y., 1981). The term "monoclonal antibody" as used herein is not limited to antibodies produced through hybridoma technology. For example, monoclonal antibodies can be produced recombinantly from host cells exogenously expressing an antibody described herein or a fragment thereof, for example, light chain and/or heavy chain of such antibody.

In specific embodiments, a "monoclonal antibody," as used herein, is an antibody produced by a single cell (e.g., hybridoma or host cell producing a recombinant antibody), wherein the antibody immunospecifically binds to GITR (e.g., human GITR) as determined, e.g., by ELISA or other antigen-binding or competitive binding assay known in the art or in the Examples provided herein. In particular embodiments, a monoclonal antibody can be a chimeric antibody or a humanized antibody. In certain embodiments, a monoclonal antibody is a monovalent antibody or multivalent (e.g., bivalent) antibody. In particular embodiments, a monoclonal antibody is a monospecific or multispecific antibody (e.g., bispecific antibody). Monoclonal antibodies described herein can, for example, be made by the hybridoma method as described in Kohler G & Milstein C (1975) Nature 256: 495 or can, e.g., be isolated from phage libraries using the techniques as described herein, for example. Other methods for the preparation of clonal cell lines and of monoclonal antibodies expressed thereby are well known in the art (see, for example, Chapter 11 in: Short Protocols in Molecular Biology, (2002) 5th Ed., Ausubel F M et al., supra).

Methods for producing and screening for specific antibodies using hybridoma technology are routine and well known in the art. For example, in the hybridoma method, a mouse or other appropriate host animal, such as a sheep, goat, rabbit, rat, hamster or macaque monkey, is immunized to elicit lymphocytes that produce or are capable of producing antibodies that will specifically bind to the protein (e.g., GITR (e.g., human GITR)) used for immunization. Alternatively, lymphocytes may be immunized in vitro. Lymphocytes then are fused with myeloma cells using a suitable fusing agent, such as polyethylene glycol, to form a hybridoma cell (Goding J W (Ed), Monoclonal Antibodies: Principles and Practice, pp. 59-103 (Academic Press, 1986)). Additionally, a RIMMS (repetitive immunization multiple sites) technique can be used to immunize an animal (Kilpatrick K E et al., (1997) Hybridoma 16:381-9, incorporated by reference in its entirety).

In some embodiments, mice (or other animals, such as rats, monkeys, donkeys, pigs, sheep, hamster, or dogs) can be immunized with an antigen (e.g., GITR (e.g., human GITR)) and once an immune response is detected, e.g., antibodies specific for the antigen are detected in the mouse serum, the mouse spleen is harvested and splenocytes isolated. The splenocytes are then fused by well known techniques to any suitable myeloma cells, for example cells from cell line SP20 available from the American Type Culture Collection (ATCC®) (Manassas, Va.), to form hybridomas. Hybridomas are selected and cloned by limited dilution. In certain embodiments, lymph nodes of the immunized mice are harvested and fused with NS0 myeloma cells.

The hybridoma cells thus prepared are seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells.

Specific embodiments employ myeloma cells that fuse efficiently, support stable high-level production of antibody by the selected antibody-producing cells, and are sensitive to a medium such as HAT medium. Among these myeloma cell lines are murine myeloma lines, such as NS0 cell line or those derived from MOPC-21 and MPC-11 mouse tumors available from the Salk Institute Cell Distribution Center, San Diego, Calif., USA, and SP-2 or X63-Ag8.653 cells available from the American Type Culture Collection, Rockville, Md., USA. Human myeloma and mouse-human heteromyeloma cell lines also have been described for the production of human monoclonal antibodies (Kozbor D (1984) J Immunol 133: 3001-5; Brodeur et al., Monoclonal Antibody Production Techniques and Applications, pp. 51-63 (Marcel Dekker, Inc., New York, 1987)).

Culture medium in which hybridoma cells are growing is assayed for production of monoclonal antibodies directed against GITR (e.g., human GITR). The binding specificity of monoclonal antibodies produced by hybridoma cells is determined by methods known in the art, for example, immunoprecipitation or by an in vitro binding assay, such as radioimmunoassay (RIA) or enzyme-linked immunoabsorbent assay (ELISA).

After hybridoma cells are identified that produce antibodies of the desired specificity, affinity, and/or activity, the clones may be subcloned by limiting dilution procedures and grown by standard methods (Goding J W (Ed), Monoclonal Antibodies: Principles and Practice, supra). Suitable culture media for this purpose include, for example, D-MEM or RPMI 1640 medium. In addition, the hybridoma cells may be grown in vivo as ascites tumors in an animal.

The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

Antibodies described herein include antibody fragments which recognize specific GITR (e.g., human GITR) and can be generated by any technique known to those of skill in the art. For example, Fab and F(ab')$_2$ fragments described herein can be produced by proteolytic cleavage of immunoglobulin molecules, using enzymes such as papain (to produce Fab fragments) or pepsin (to produce F(ab')$_2$ fragments). A Fab fragment corresponds to one of the two identical arms of an antibody molecule and contains the complete light chain paired with the VH and CH1 domains of the heavy chain. A F(ab')$_2$ fragment contains the two antigen-binding arms of an antibody molecule linked by disulfide bonds in the hinge region.

Further, the antibodies described herein or antigen-binding fragments thereof can also be generated using various phage display methods known in the art. In phage display methods, functional antibody domains are displayed on the surface of phage particles which carry the polynucleotide sequences encoding them. In particular, DNA sequences encoding VH and VL domains are amplified from animal cDNA libraries (e.g., human or murine cDNA libraries of affected tissues). The DNA encoding the VH and VL domains are recombined together with a scFv linker by PCR and cloned into a phagemid vector. The vector is electroporated in E. coli and the E. coli is infected with helper phage. Phage used in these methods are typically filamentous phage including fd and M13, and the VH and VL domains are usually recombinantly fused to either the phage gene III or gene VIII. Phage expressing an antigen binding domain that binds to a particular antigen can be selected or identified with antigen, e.g., using labeled antigen or antigen bound or captured to a solid surface or bead. Examples of phage display methods that can be used to make the antibodies described herein include those disclosed in Brinkman U et al., (1995) J Immunol Methods 182: 41-50; Ames R S et al., (1995) J Immunol Methods 184: 177-186; Kettleborough C A et al., (1994) Eur J Immunol 24: 952-958; Persic L et al., (1997) Gene 187: 9-18; Burton D R & Barbas C F (1994) Advan Immunol 57: 191-280; PCT Application No. PCT/GB91/001134; International Publication Nos. WO 90/02809, WO 91/10737, WO 92/01047, WO 92/18619, WO 93/1 1236, WO 95/15982, WO 95/20401, and WO 97/13844; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727, 5,733,743 and 5,969,108.

As described in the above references, after phage selection, the antibody coding regions from the phage can be isolated and used to generate whole antibodies, including human antibodies, or any other desired antigen binding fragment, and expressed in any desired host, including mammalian cells, insect cells, plant cells, yeast, and bacteria, e.g., as described below. Techniques to recombinantly produce antibody fragments such as Fab, Fab' and F(ab)$_2$ fragments can also be employed using methods known in the art such as those disclosed in PCT publication No. WO 92/22324; Mullinax R L et al., (1992) BioTechniques 12(6): 864-9; Sawai H et al., (1995) Am J Reprod Immunol 34: 26-34; and Better M et al., (1988) Science 240: 1041-1043.

In one aspect, to generate whole antibodies, PCR primers including VH or VL nucleotide sequences, a restriction site, and a flanking sequence to protect the restriction site can be used to amplify the VH or VL sequences from a template, e.g., scFv clones. Utilizing cloning techniques known to those of skill in the art, the PCR amplified VH domains can be cloned into vectors expressing a VH constant region, and the PCR amplified VL domains can be cloned into vectors expressing a VL constant region, e.g., human kappa or lambda constant regions. The VH and VL domains can also be cloned into one vector expressing the necessary constant regions. The heavy chain conversion vectors and light chain conversion vectors are then co-transfected into cell lines to generate stable or transient cell lines that express full-length antibodies, e.g., IgG, using techniques known to those of skill in the art.

A chimeric antibody is a molecule in which different portions of the antibody are derived from different immunoglobulin molecules. For example, a chimeric antibody can contain a variable region of a mouse or rat monoclonal antibody fused to a constant region of a human antibody. Methods for producing chimeric antibodies are known in the art. See, e.g., Morrison S L (1985) Science 229: 1202-7; Oi V T & Morrison S L (1986) BioTechniques 4: 214-221; Gillies S D et al., (1989) J Immunol Methods 125: 191-202; and U.S. Pat. Nos. 5,807,715, 4,816,567, 4,816,397, and 6,331,415.

A humanized antibody is capable of binding to a predetermined antigen and which comprises a framework region having substantially the amino acid sequence of a human immunoglobulin and CDRs having substantially the amino acid sequence of a non-human immunoglobulin (e.g., a murine immunoglobulin). In particular embodiments, a humanized antibody also comprises at least a portion of an immunoglobulin constant region (Fc), typically that of a human immunoglobulin. The antibody also can include the CH1, hinge, CH2, CH3, and CH4 regions of the heavy chain. A humanized antibody can be selected from any class of immunoglobulins, including IgM, IgG, IgD, IgA and IgE, and any isotype, including IgG$_1$, IgG$_2$, IgG$_3$ and IgG$_4$. Humanized antibodies can be produced using a variety of techniques known in the art, including but not limited to, CDR-grafting (European Patent No. EP 239400; International Publication No. WO 91/09967; and U.S. Pat. Nos. 5,225,539, 5,530,101, and 5,585,089), veneering or resurfacing (European Patent Nos. EP 592106 and EP 519596; Padlan E A (1991) Mol Immunol 28(4/5): 489-498; Studnicka G M et al., (1994) Prot Engineering 7(6): 805-814; and Roguska M A et al., (1994) PNAS 91: 969-973), chain shuffling (U.S. Pat. No. 5,565,332), and techniques disclosed in, e.g., U.S. Pat. Nos. 6,407,213, 5,766,886, International Publication No. WO 93/17105; Tan P et al., (2002) J Immunol 169: 1119-25; Caldas C et al., (2000) Protein Eng. 13(5): 353-60; Morea V et al., (2000) Methods 20(3): 267-79; Baca M et al., (1997) J Biol Chem 272(16): 10678-84; Roguska M A et al., (1996) Protein Eng 9(10): 895 904; Couto J R et al., (1995) Cancer Res. 55 (23 Supp): 5973s-5977s; Couto J R et al., (1995) Cancer Res 55(8): 1717-22; Sandhu J S (1994) Gene 150(2): 409-10 and Pedersen J T et al., (1994) J Mol Biol 235(3): 959-73. See also U.S. Application Publication No. US 2005/0042664 A1 (Feb. 24, 2005), which is incorporated by reference herein in its entirety.

Methods for making multispecific (e.g., bispecific antibodies) have been described, see, for example, U.S. Pat. Nos. 7,951,917; 7,183,076; 8,227,577; 5,837,242; 5,989,830; 5,869,620; 6,132,992 and 8,586,713.

Single domain antibodies, for example, antibodies lacking the light chains, can be produced by methods well known in the art. See Riechmann L & Muyldermans S (1999) J Immunol 231: 25-38; Nuttall S D et al., (2000) Curr Pharm Biotechnol 1(3): 253-263; Muyldermans S, (2001) J Biotechnol 74(4): 277-302; U.S. Pat. No. 6,005,079; and International Publication Nos. WO 94/04678, WO 94/25591 and WO 01/44301.

Further, antibodies that immunospecifically bind to a GITR antigen can, in turn, be utilized to generate anti-idiotype antibodies that "mimic" an antigen using techniques well known to those skilled in the art. (See, e.g., Greenspan N S & Bona C A (1989) FASEB J 7(5): 437-444; and Nissinoff A (1991) J Immunol 147(8): 2429-2438).

In particular embodiments, an antibody described herein, which binds to the same epitope of GITR (e.g., human GITR) as an anti-GITR antibody described herein, is a human antibody or an antigen-binding fragment thereof. In particular embodiments, an antibody described herein, which competitively blocks (e.g., in a dose-dependent manner) any one of the antibodies described herein, (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, pab2161, or Hum231#2w) from binding to GITR (e.g., human GITR), is a human antibody or an antigen-binding fragment thereof. Human antibodies can be produced using any method known in the art. For example, transgenic mice which are incapable of expressing functional endogenous immunoglobulins, but which can express human immunoglobulin genes, can be used. In particular, the human heavy and light chain immunoglobulin gene complexes can be introduced randomly or by homologous recombination into mouse embryonic stem cells. Alternatively, the human variable region, constant region, and diversity region can be introduced into mouse embryonic stem cells in addition to the human heavy and light chain genes. The mouse heavy and light chain immunoglobulin genes can be rendered non-functional separately or simultaneously with the introduction of human immunoglobulin loci by homologous recombination. In particular, homozygous deletion of the $J_H$ region prevents endogenous antibody production. The modified embryonic stem cells are expanded and microinjected into blastocysts to produce chimeric mice. The chimeric mice are then bred to produce homozygous offspring which express human antibodies. The transgenic mice are immunized in the normal fashion with a selected antigen, e.g., all or a portion of an antigen (e.g., GITR). Monoclonal antibodies directed against the antigen can be obtained from the immunized, transgenic mice using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA, IgM and IgE antibodies. For an overview of this technology for producing human antibodies, see Lonberg N & Huszar D (1995) Int Rev Immunol 13:65-93. For a detailed discussion of this technology for producing human antibodies and human monoclonal antibodies and protocols for producing such antibodies, see, e.g., International Publication Nos. WO 98/24893, WO 96/34096 and WO 96/33735; and U.S. Pat. Nos. 5,413,923, 5,625,126, 5,633,425, 5,569,825, 5,661,016, 5,545,806, 5,814,318 and 5,939,598. Examples of mice capable of producing human antibodies include the Xenomouse™ (Abgenix, Inc.; U.S. Pat. Nos. 6,075,181 and 6,150,184), the HuAb-Mouse™ (Mederex, Inc./Gen Pharm; U.S. Pat. Nos. 5,545,806 and 5,569,825), the Trans Chromo Mouse™ (Kirin) and the KM Mouse™ (Medarex/Kirin).

Human antibodies which specifically bind to GITR (e.g., human GITR) can be made by a variety of methods known in the art including phage display methods described above using antibody libraries derived from human immunoglobulin sequences. See also U.S. Pat. Nos. 4,444,887, 4,716,111, and 5,885,793; and International Publication Nos. WO 98/46645, WO 98/50433, WO 98/24893, WO 98/16654, WO 96/34096, WO 96/33735, and WO 91/10741.

In some embodiments, human antibodies can be produced using mouse-human hybridomas. For example, human peripheral blood lymphocytes transformed with Epstein-Barr virus (EBV) can be fused with mouse myeloma cells to produce mouse-human hybridomas secreting human monoclonal antibodies, and these mouse-human hybridomas can be screened to determine ones which secrete human monoclonal antibodies that immunospecifically bind to a target antigen (e.g., GITR (e.g., human GITR)). Such methods are known and are described in the art, see, e.g., Shinmoto H et al., (2004) Cytotechnology 46: 19-23; Naganawa Y et al., (2005) Human Antibodies 14: 27-31.

5.2.1 Polynucleotides

In certain aspects, provided herein are polynucleotides comprising a nucleotide sequence encoding an antibody described herein or a fragment thereof (e.g., a variable light chain region and/or variable heavy chain region) that immunospecifically binds to a GITR (e.g., human GITR) antigen, and vectors, e.g., vectors comprising such polynucleotides for recombinant expression in host cells (e.g., E. coli and mammalian cells). Provided herein are polynucleotides comprising nucleotide sequences encoding any of the antibodies provided herein, as well as vectors comprising such polynucleotide sequences, e.g., expression vectors for their efficient expression in host cells, e.g., mammalian cells.

As used herein, an "isolated" polynucleotide or nucleic acid molecule is one which is separated from other nucleic acid molecules which are present in the natural source (e.g., in a mouse or a human) of the nucleic acid molecule. Moreover, an "isolated" nucleic acid molecule, such as a c molecule, can be substantially free of other cellular material, or culture medium when produced by recombinant techniques, or substantially free of chemical precursors or other chemicals when chemically synthesized. For example, the language "substantially free" includes preparations of polynucleotide or nucleic acid molecule having less than about 15%, 10%, 5%, 2%, 1%, 0.5%, or 0.1% (in particular less than about 10%) of other material, e.g., cellular material, culture medium, other nucleic acid molecules, chemical precursors and/or other chemicals. In a specific embodiment, a nucleic acid molecule(s) encoding an antibody described herein is isolated or purified.

In particular aspects, provided herein are polynucleotides comprising nucleotide sequences encoding antibodies or antigen-binding fragments thereof, which immunospecifically bind to a GITR polypeptide (e.g., human GITR) and comprises an amino acid sequence as described herein, as well as antibodies which compete with such antibodies for binding to a GITR polypeptide (e.g., in a dose-dependent manner), or which binds to the same epitope as that of such antibodies.

In certain aspects, provided herein are polynucleotides comprising a nucleotide sequence encoding the light chain or heavy chain of an antibody described herein. The polynucleotides can comprise nucleotide sequences encoding a light chain comprising the VL FRs and CDRs of antibodies described herein (see, e.g., Tables 1 and 3). The polynucleotides can comprise nucleotide sequences encoding a heavy chain comprising the VH FRs and CDRs of antibodies described herein (see, e.g., Tables 2 and 4). In specific embodiments, a polynucleotide described herein encodes a VL domain comprising an amino acid sequence selected from the group consisting of SEQ ID NO: 202, 204, 205, 207, 208, and 400-518. In specific embodiments, a polynucleotide described herein encodes a VL domain comprising the amino acid sequence of SEQ ID NO: 519. In specific embodiments, a polynucleotide described herein encodes a VH domain comprising an amino acid sequence selected from the group consisting of SEQ ID NOs: 201, 203, 206, and 215-389. In specific embodiments, a polynucleotide described herein encodes a VL domain comprising the amino acid sequence of any one of antibodies 231-32-15, Hum231#1 or Hum231#2 (e.g., SEQ ID NOs: 202, 207 or 208). In specific embodiments, a polynucleotide described herein encodes a VH domain comprising the amino acid sequence of any one of antibodies 231-32-15, Hum231#1 or Hum231#2 (e.g., SEQ ID NOs: 201 or 206). In specific embodiments, a polynucleotide described herein encodes a VL domain and a VH domain comprising the amino acid sequence of any one of antibodies 231-32-15, Hum231#1 or Hum231#2 (e.g., SEQ ID NOs: 201-202 and/or 206-208).

In particular embodiments, provided herein are polynucleotides comprising a nucleotide sequence encoding an anti-GITR antibody comprising three VL chain CDRs, e.g., containing VL CDR1, VL CDR2, and VL CDR3 of any one of antibodies described herein (e.g., see Table 1, for example, the VL CDRs in one row in Table 1). In specific embodiments, provided herein are polynucleotides comprising three VH chain CDRs, e.g., containing VH CDR1, VH CDR2, and VH CDR3 of any one of antibodies described herein (e.g., see Table 2, for example, the VH CDRs in one row in Table 2). In specific embodiments, provided herein are polynucleotides comprising a nucleotide sequence encoding an anti-GITR antibody comprising three VH chain CDRs, e.g., containing VL CDR1, VL CDR2, and VL CDR3 of any one of antibodies described herein (e.g., see Table 1, e.g., the VL CDRs in one row in Table 1) and three VH chain CDRs, e.g., containing VH CDR1, VH CDR2, and VH CDR3 of any one of antibodies described herein (e.g., see Table 2, e.g., the VH CDRs in one row in Table 2). In specific embodiments, a polynucleotide described herein encodes the VL CDRs of any one of antibodies 231-32-15, Hum231#1 or Hum231#2 (e.g., SEQ ID NOs: 16, 17, or 18). In specific embodiments, a polynucleotide described herein encodes the VH CDRs of any one of antibodies 231-32-15, Hum231#1 or Hum231#2 (e.g., SEQ ID NOs: 13, 14, or 15). In specific embodiments, a polynucleotide described herein encodes VL CDRs and VH CDRs of any one of antibodies 231-32-15, Hum231#1 or Hum231#2 (e.g., SEQ ID NOs: 13-18).

In particular embodiments, provided herein are polynucleotides comprising a nucleotide sequence encoding an anti-GITR antibody comprising a VL domain, e.g., containing FR1-CDR1-FR2-CDR2-FR3-CDR3-FR4, comprising an amino acid sequence described herein (e.g., see Tables 1 and 3, e.g., the VL CDRs and VLFRs of a particular antibody identified by name in the tables). In specific embodiments, provided herein are polynucleotides comprising a nucleotide sequence encoding an anti-GITR antibody comprising a VH domain, e.g., containing FR1-CDR1-FR2-CDR2-FR3-CDR3-FR4, comprising an amino acid sequence described herein (e.g., see Tables 2 and 4, e.g., the VH CDRs and VH FRs of a particular antibody identified by name in the Tables).

In certain embodiments, a polynucleotide described herein comprises a nucleotide sequence encoding an antibody provided herein comprising a light chain variable region comprising an amino acid sequence described herein (e.g., SEQ ID NOs: 202, 204, 205, 207, 208, and 400-518 or SEQ ID NO:519), wherein the antibody immunospecifically binds to GITR (e.g., human GITR). In a certain embodiment, a polynucleotide described herein comprises a nucleotide sequence encoding antibodies Hum231#1 or Hum231#2 or Hum231#2w provided herein comprising a light chain variable region comprising an amino acid sequence described herein (e.g., SEQ ID NOs: 207 or 208).

In certain embodiments, a polynucleotide described herein comprises a nucleotide sequence encoding an antibody provided herein comprising a heavy chain variable region comprising an amino acid sequence described herein (e.g., SEQ ID NO: 201, 203, 206, and 215-389), wherein the antibody immunospecifically binds to GITR (e.g., human GITR). In a certain embodiment, a polynucleotide described herein comprises a nucleotide sequence encoding antibodies Hum231#1, Hum231#2 or Hum231#2w provided herein comprising a heavy chain variable region comprising an amino acid sequence described herein (e.g., SEQ ID NO: 206).

In certain aspects, a polynucleotide comprises a nucleotide sequence encoding an antibody described herein comprising a VL domain comprising one or more VL FRs having the amino acid sequence described herein (e.g., see Table 3, e.g., the framework regions in one row of the table), wherein the antibody immunospecifically binds to GITR (e.g., human GITR). In certain aspects, a polynucleotide comprises a nucleotide sequence encoding an antibody described herein comprising a VH domain comprising one or more VH FRs having the amino acid sequence described herein (e.g., see Table 4, e.g., the framework regions in one row of the table), wherein the antibody immunospecifically binds to GITR (e.g., human GITR).

In specific embodiments, a polynucleotide provided herein comprises a nucleotide sequence encoding an antibody described herein comprising: framework regions (e.g., framework regions of the VL domain and VH domain) that are human framework regions, wherein the antibody immunospecifically binds GITR (e.g., human GITR). In certain embodiments, a polynucleotide provided herein comprises a nucleotide sequence encoding an antibody or fragment thereof (e.g., CDRs or variable domain) described in Section 5.1 above.

In specific aspects, provided herein is a polynucleotide comprising a nucleotide sequence encoding an antibody comprising a light chain and a heavy chain, e.g., a separate light chain and heavy chain. With respect to the light chain, in a specific embodiment, a polynucleotide provided herein comprises a nucleotide sequence encoding a kappa light chain. In another specific embodiment, a polynucleotide provided herein comprises a nucleotide sequence encoding a lambda light chain. In yet another specific embodiment, a polynucleotide provided herein comprises a nucleotide sequence encoding an antibody described herein comprising a human kappa light chain or a human lambda light chain. In a particular embodiment, a polynucleotide provided herein comprises a nucleotide sequence encoding an antibody described herein, which immunospecifically binds to GITR (e.g., human GITR), wherein the antibody comprises a light chain, and wherein the amino acid sequence of the VL domain can comprise any amino acid sequence described herein (e.g., SEQ ID NO: 202, 204, 205, 207, 208 and 400-518 or SEQ ID NO:519), and wherein the constant region of the light chain comprises the amino acid sequence of a human kappa light chain constant region. In another particular embodiment, a polynucleotide provided herein comprises a nucleotide sequence encoding an antibody described herein, which immunospecifically binds to GITR (e.g., human GITR), and comprises a light chain, wherein the amino acid sequence of the VL domain can comprises any amino acid sequence described herein (e.g., SEQ ID NO: 202, 204, 205, 207, 208 and 400-518 or SEQ ID NO:519), and wherein the constant region of the light chain comprises the amino acid sequence of a human lambda light chain constant region. For example, human constant region sequences can be those described in U.S. Pat. No. 5,693,780.

In a particular embodiment, a polynucleotide provided herein comprises a nucleotide sequence encoding an antibody described herein, which immunospecifically binds to GITR (e.g., human GITR), wherein the antibody comprises a heavy chain, wherein the amino acid sequence of the VH domain can comprise any amino acid sequence described herein (e.g., SEQ ID NO: 201, 203, 206 and 215-389), and wherein the constant region of the heavy chain comprises the amino acid sequence of a human gamma (γ) heavy chain constant region.

In a certain embodiment, a polynucleotide provided herein comprises a nucleotide sequence(s) encoding a VH domain and/or a VL domain of an antibody described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107 such as SEQ ID NO: 209 or 800-974 for the VH domain or SEQ ID NO: 210, 211 or 1001-1126 for the VL domain), which immunospecifically binds to GITR (e.g., human GITR). In a certain embodiment, a polynucleotide provided herein comprises a nucleotide sequence(s) encoding a VH domain and/or a VL domain of an antibody described herein (e.g., Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, or pab2161 such as SEQ ID NO: 209 or 800-974 for the VH domain or SEQ ID NO: 210, 211 or 1000-1118 for the VL domain), which immunospecifically binds to GITR (e.g., human GITR). In a certain embodiment, a polynucleotide provided herein comprises a nucleotide sequence(s) encoding a VH domain and/or a VL domain of antibody Hum231#1 or Hum231# (e.g., SEQ ID NOs: 209-211).

In yet another specific embodiment, a polynucleotide provided herein comprises a nucleotide sequence encoding an antibody described herein (or an antigen-binding fragment thereof), which immunospecifically binds GITR (e.g., human GITR), wherein the antibody comprises a VL domain and a VH domain comprising any amino acid sequences described herein, and wherein the constant regions comprise the amino acid sequences of the constant regions of a human IgG$_1$ (e.g., allotype 1, 17, or 3) or human IgG$_4$.

In a specific embodiment, provided herein are polynucleotides comprising a nucleotide sequence encoding an anti-GITR antibody, or an antigen-binding fragment or domain thereof, designated herein, see, e.g., Tables 1-4, for example antibody Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15, or antibodies 1-107, or antibodies pab2159, pab2160, pab2161, or Hum231#2w.

Also provided herein are polynucleotides encoding an anti-GITR antibody or a fragment thereof that are optimized, e.g., by codon/RNA optimization, replacement with heterologous signal sequences, and elimination of mRNA instability elements. Methods to generate optimized nucleic acids encoding an anti-GITR antibody or a fragment thereof (e.g., light chain, heavy chain, VH domain, or VL domain) for recombinant expression by introducing codon changes and/or eliminating inhibitory regions in the mRNA can be carried out by adapting the optimization methods described in, e.g., U.S. Pat. Nos. 5,965,726; 6,174,666; 6,291,664; 6,414,132; and 6,794,498, accordingly. For example, potential splice sites and instability elements (e.g., A/T or A/U rich elements) within the RNA can be mutated without altering the amino acids encoded by the nucleic acid sequences to increase stability of the RNA for recombinant expression. The alterations utilize the degeneracy of the genetic code, e.g., using an alternative codon for an identical amino acid. In some embodiments, it can be desirable to alter one or more codons to encode a conservative mutation, e.g., a similar amino acid with similar chemical structure and properties and/or function as the original amino acid. Such methods can increase expression of an anti-GITR antibody or fragment thereof by at least 1 fold, 2 fold, 3 fold, 4 fold, 5 fold, 10 fold, 20 fold, 30 fold, 40 fold, 50 fold, 60 fold, 70 fold, 80 fold, 90 fold, or 100 fold or more relative to the expression of an anti-GITR antibody encoded by polynucleotides that have not been optimized.

In certain embodiments, an optimized polynucleotide sequence encoding an anti-GITR antibody described herein or a fragment thereof (e.g., VL domain and/or VH domain) can hybridize to an antisense (e.g., complementary) polynucleotide of an unoptimized polynucleotide sequence encoding an anti-GITR antibody described herein or a fragment thereof (e.g., VL domain and/or VH domain). In specific embodiments, an optimized nucleotide sequence encoding an anti-GITR antibody described herein or a fragment hybridizes under high stringency conditions to antisense polynucleotide of an unoptimized polynucleotide sequence encoding an anti-GITR antibody described herein or a fragment thereof. In a specific embodiment, an optimized nucleotide sequence encoding an anti-GITR antibody described herein or a fragment thereof hybridizes under high stringency, intermediate or lower stringency hybridization conditions to an antisense polynucleotide of an unoptimized nucleotide sequence encoding an anti-GITR antibody described herein or a fragment thereof. Information regarding hybridization conditions has been described, see, e.g., U.S. Patent Application Publication No. US 2005/0048549 (e.g., paragraphs 72-73), which is incorporated herein by reference.

The polynucleotides can be obtained, and the nucleotide sequence of the polynucleotides determined, by any method known in the art. Nucleotide sequences encoding antibodies described herein, e.g., antibodies described in Tables 1-4, and modified versions of these antibodies can be determined using methods well known in the art, i.e., nucleotide codons known to encode particular amino acids are assembled in such a way to generate a nucleic acid that encodes the antibody. Such a polynucleotide encoding the antibody can be assembled from chemically synthesized oligonucleotides (e.g., as described in Kutmeier G et al., (1994), BioTechniques 17: 242-6), which, briefly, involves the synthesis of overlapping oligonucleotides containing portions of the sequence encoding the antibody, annealing and ligating of those oligonucleotides, and then amplification of the ligated oligonucleotides by PCR.

Alternatively, a polynucleotide encoding an antibody described herein can be generated from nucleic acid from a suitable source (e.g., a hybridoma) using methods well known in the art (e.g., PCR and other molecular cloning methods). For example, PCR amplification using synthetic primers hybridizable to the 3' and 5' ends of a known sequence can be performed using genomic DNA obtained from hybridoma cells producing the antibody of interest. Such PCR amplification methods can be used to obtain nucleic acids comprising the sequence encoding the light chain and/or heavy chain of an antibody. Such PCR amplification methods can be used to obtain nucleic acids comprising the sequence encoding the variable light chain region and/or the variable heavy chain region of an antibody. The amplified nucleic acids can be cloned into vectors for expression in host cells and for further cloning, for example, to generate chimeric and humanized antibodies.

If a clone containing a nucleic acid encoding a particular antibody is not available, but the sequence of the antibody molecule is known, a nucleic acid encoding the immunoglobulin can be chemically synthesized or obtained from a suitable source (e.g., an antibody cDNA library or a cDNA library generated from, or nucleic acid, preferably poly A+RNA, isolated from, any tissue or cells expressing the antibody, such as hybridoma cells selected to express an antibody described herein) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR can then be cloned into replicable cloning vectors using any method well known in the art.

DNA encoding anti-GITR antibodies described herein can be readily isolated and sequenced using conventional procedures (e.g., by using oligonucleotide probes that are capable of binding specifically to genes encoding the heavy and light chains of the anti-GITR antibodies). Hybridoma cells can serve as a source of such DNA. Once isolated, the DNA can be placed into expression vectors, which are then transfected into host cells such as *E. coli* cells, simian COS cells, Chinese hamster ovary (CHO) cells (e.g., CHO cells from the CHO GS System™ (Lonza)), or myeloma cells that do not otherwise produce immunoglobulin protein, to obtain the synthesis of anti-GITR antibodies in the recombinant host cells.

To generate whole antibodies, PCR primers including VH or VL nucleotide sequences, a restriction site, and a flanking sequence to protect the restriction site can be used to amplify the VH or VL sequences in scFv clones. Utilizing cloning techniques known to those of skill in the art, the PCR amplified VH domains can be cloned into vectors expressing a heavy chain constant region, e.g., the human gamma 4 constant region, and the PCR amplified VL domains can be cloned into vectors expressing a light chain constant region, e.g., human kappa or lambda constant regions. In certain embodiments, the vectors for expressing the VH or VL domains comprise an EF-1α promoter, a secretion signal, a cloning site for the variable domain, constant domains, and a selection marker such as neomycin. The VH and VL domains can also be cloned into one vector expressing the necessary constant regions. The heavy chain conversion vectors and light chain conversion vectors are then co-transfected into cell lines to generate stable or transient cell lines that express full-length antibodies, e.g., IgG, using techniques known to those of skill in the art.

The DNA also can be modified, for example, by substituting the coding sequence for human heavy and light chain constant domains in place of the murine sequences, or by covalently joining to the immunoglobulin coding sequence all or part of the coding sequence for a non-immunoglobulin polypeptide.

Also provided are polynucleotides that hybridize under high stringency, intermediate or lower stringency hybridization conditions to polynucleotides that encode an antibody described herein. In specific embodiments, polynucleotides described herein hybridize under high stringency, intermediate or lower stringency hybridization conditions to polynucleotides encoding a VH domain (e.g., SEQ ID NO: 201, 203, 206, and 215-389) and/or VL domain (e.g., 202, 204, 205, 207, 208, and 400-518 or SEQ ID NO: 519) provided herein.

Hybridization conditions have been described in the art and are known to one of skill in the art. For example, hybridization under stringent conditions can involve hybridization to filter-bound DNA in 6× sodium chloride/sodium citrate (SSC) at about 45° C. followed by one or more washes in 0.2×SSC/0.1% SDS at about 50-65° C.; hybridization under highly stringent conditions can involve hybridization to filter-bound nucleic acid in 6×SSC at about 45° C. followed by one or more washes in 0.1×SSC/0.2% SDS at about 68° C. Hybridization under other stringent hybridization conditions are known to those of skill in the art and have been described, see, for example, Ausubel F M et al., eds., (1989) Current Protocols in Molecular Biology, Vol. I, Green Publishing Associates, Inc. and John Wiley & Sons, Inc., New York at pages 6.3.1-6.3.6 and 2.10.3.

5.2.2 Cells and Vectors

In certain aspects, provided herein are cells (e.g., host cells) expressing (e.g., recombinantly) antibodies described herein (or an antigen-binding fragment thereof) which specifically bind to GITR (e.g., human GITR) and related polynucleotides and expression vectors. Provided herein are vectors (e.g., expression vectors) comprising polynucleotides comprising nucleotide sequences encoding anti-GITR antibodies or a fragment for recombinant expression in host cells, preferably in mammalian cells. Also provided herein are host cells comprising such vectors for recombinantly expressing anti-GITR antibodies described herein (e.g., human or humanized antibody). In a particular aspect, provided herein are methods for producing an antibody described herein, comprising expressing such antibody from a host cell.

Recombinant expression of an antibody described herein (e.g., a full-length antibody, heavy and/or light chain of an antibody, or a single chain antibody described herein) that specifically binds to GITR (e.g., human GITR) involves construction of an expression vector containing a polynucleotide that encodes the antibody. Once a polynucleotide encoding an antibody molecule, heavy and/or light chain of an antibody, or a fragment thereof (e.g., heavy and/or light chain variable domains) described herein has been obtained, the vector for the production of the antibody molecule can be produced by recombinant DNA technology using techniques well known in the art. Thus, methods for preparing a protein by expressing a polynucleotide containing an antibody or antibody fragment (e.g., light chain or heavy chain) encoding nucleotide sequence are described herein. Methods which are well known to those skilled in the art can be used to construct expression vectors containing antibody or antibody fragment (e.g., light chain or heavy chain) coding sequences and appropriate transcriptional and translational control signals. These methods include, for example, in vitro recombinant DNA techniques, synthetic techniques, and in vivo genetic recombination. Also provided are replicable vectors comprising a nucleotide sequence encoding an antibody molecule described herein, a heavy or light chain of an antibody, a heavy or light chain variable domain of an antibody or a fragment thereof, or a heavy or light chain CDR, operably linked to a promoter. Such vectors can, for example, include the nucleotide sequence encoding the constant region of the antibody molecule (see, e.g., International Publication Nos. WO 86/05807 and WO 89/01036; and U.S. Pat. No. 5,122,464) and variable domains of the antibody can be cloned into such a vector for expression of the entire heavy, the entire light chain, or both the entire heavy and light chains.

An expression vector can be transferred to a cell (e.g., host cell) by conventional techniques and the resulting cells can then be cultured by conventional techniques to produce an antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161) or a fragment thereof. Thus, provided herein are host cells containing a polynucleotide encoding an antibody described herein or fragments thereof, or a heavy or light chain thereof, or fragment thereof, or a single chain antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), operably linked to a promoter for expression of such sequences in the host cell. In certain embodiments, for the expression of double-chained antibodies, vectors encoding both the heavy and light chains, individually, can be co-expressed in the host cell for expression of the entire immunoglobulin molecule, as detailed below. In certain embodiments, a host cell contains a vector comprising a polynucleotide encoding both the heavy chain and light chain of an antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), or a fragment thereof. In specific embodiments, a host cell contains two different vectors, a first vector comprising a polynucleotide encoding a heavy chain or a heavy chain variable region of an antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), or a fragment thereof, and a second vector comprising a polynucleotide encoding a light chain or a light chain variable region of an antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), or a fragment thereof. In other embodiments, a first host cell comprises a first vector comprising a polynucleotide encoding a heavy chain or a heavy chain variable region of an antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), or a fragment thereof, and a second host cell comprises a second vector comprising a polynucleotide encoding a light chain or a light chain variable region of an antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161). In specific embodiments, a heavy chain/heavy chain variable region expressed by a first cell associated with a light chain/light chain variable region of a second cell to form an anti-GITR antibody described herein (e.g., antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161) or an antigen-binding fragment thereof. In certain embodiments, provided herein is a population of host cells comprising such first host cell and such second host cell.

In a particular embodiment, provided herein is a population of vectors comprising a first vector comprising a polynucleotide encoding a light chain/light chain variable region of an anti-GITR antibody described herein (e.g., antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161), and a second vector comprising a polynucleotide encoding a heavy chain/heavy chain variable region of an anti-GITR antibody described herein (e.g., antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161).

A variety of host-expression vector systems can be utilized to express antibody molecules described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161 (see, e.g., U.S. Pat. No. 5,807,715). Such host-expression systems represent vehicles by which the coding sequences of interest can be produced and subsequently purified, but also represent cells which can, when transformed or transfected with the appropriate nucleotide coding sequences, express an antibody molecule described herein in situ. These include but are not limited to microorganisms such as bacteria (e.g., *E. coli* and *B. subtilis*) transformed with recombinant bacteriophage DNA, plasmid DNA or cosmid DNA expression vectors containing antibody coding sequences; yeast (e.g., *Saccharomyces Pichia*) transformed with recombinant yeast expression vectors containing antibody coding sequences; insect cell systems infected with recombinant virus expression vectors (e.g., baculovirus) containing antibody coding sequences; plant cell systems (e.g., green algae such as *Chlamydomonas reinhardtii*) infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS (e.g., COS1 or COS), CHO, BHK, MDCK, HEK 293, NS0, PER.C6, VERO, CRL7O3O, HsS78Bst, HeLa, and NIH 3T3, HEK-293T, HepG2, SP210, R1.1, B-W, L-M, BSC1, BSC40, YB/20 and BMT10 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). In a specific embodiment, cells for expressing antibodies described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161) or an antigen-binding fragment thereof are CHO cells, for example CHO cells from the CHO GS System™ (Lonza). In a particular embodiment, cells for expressing antibodies described herein are human cells, e.g., human cell lines. In a specific embodiment, a mammalian expression vector is pOptiVEC™ or pcDNA3.3. In a particular embodiment, bacterial cells such as *Escherichia coli*, or eukaryotic cells (e.g., mammalian cells), especially for the expression of whole recombinant antibody molecule, are used for the expression of a recombinant antibody molecule. For example, mammalian cells such as Chinese hamster ovary (CHO) cells, in conjunction with a vector such as the major intermediate early gene promoter element from human cytomegalovirus is an effective expression system for antibodies (Foecking M K & Hofstetter H (1986) Gene 45: 101-5; and Cockett M I et al., (1990) Biotechnology 8(7): 662-7). In certain embodiments, antibodies described herein are produced by CHO cells or NS0 cells. In a specific embodiment, the expression of nucleotide sequences encoding antibodies described herein which immunospecifically bind GITR (e.g., human GITR) is regulated by a constitutive promoter, inducible promoter or tissue specific promoter.

In bacterial systems, a number of expression vectors can be advantageously selected depending upon the use intended for the antibody molecule being expressed. For example, when a large quantity of such an antibody is to be produced, for the generation of pharmaceutical compositions of an antibody molecule, vectors which direct the expression of high levels of fusion protein products that are readily purified can be desirable. Such vectors include, but are not limited to, the *E. coli* expression vector pUR278 (Ruether U & Mueller-Hill B (1983) EMBO J 2: 1791-1794), in which the antibody coding sequence can be ligated individually into the vector in frame with the lac Z coding region so that a fusion protein is produced; pIN vectors (Inouye S & Inouye M (1985) Nuc Acids Res 13: 3101-3109; Van Heeke G & Schuster S M (1989) J Biol Chem 24: 5503-5509); and the like. For example, pGEX vectors can also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or factor Xa protease cleavage sites so that the cloned target gene product can be released from the GST moiety.

In an insect system, *Autographa californica* nuclear polyhedrosis virus (AcNPV), for example, can be used as a vector to express foreign genes. The virus grows in *Spodoptera frugiperda* cells. The antibody coding sequence can be cloned individually into non-essential regions (for example the polyhedrin gene) of the virus and placed under control of an AcNPV promoter (for example the polyhedrin promoter).

In mammalian host cells, a number of viral-based expression systems can be utilized. In cases where an adenovirus is used as an expression vector, the antibody coding sequence of interest can be ligated to an adenovirus transcription/translation control complex, e.g., the late promoter and tripartite leader sequence. This chimeric gene can then be inserted in the adenovirus genome by in vitro or in vivo recombination. Insertion in a non-essential region of the viral genome (e.g., region E1 or E3) will result in a recombinant virus that is viable and capable of expressing the antibody molecule in infected hosts (e.g., see Logan J & Shenk T (1984) PNAS 81(12): 3655-9). Specific initiation signals can also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression can be enhanced by the inclusion of appropriate transcription enhancer elements, transcription terminators, etc. (see, e.g., Bitter G et al., (1987) Methods Enzymol. 153: 516-544).

In addition, a host cell strain can be chosen which modulates the expression of the inserted sequences, or modifies and processes the gene product in the specific fashion desired. Such modifications (e.g., glycosylation) and processing (e.g., cleavage) of protein products can be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product can be used. Such mammalian host cells include but are not limited to CHO, VERO, BHK, Hela, MDCK, HEK 293, NIH 3T3, W138, BT483, Hs578T, HTB2, BT2O and T47D, NS0 (a murine myeloma cell line that does not endogenously produce any immunoglobulin chains), CRL7O3O, COS (e.g., COS1 or COS), PER.C6, VERO, HsS78Bst, HEK-293T, HepG2, SP210, R1.1, B-W, L-M, BSC1, BSC40, YB/20, BMT10 and HsS78Bst cells. In certain embodiments, anti-GITR antibodies described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161) are produced in mammalian cells, such as CHO cells.

In a specific embodiment, the antibodies described herein or antigen-binding fragments thereof have reduced fucose content or no fucose content. Such antibodies can be produced using techniques known one skilled in the art. For example, the antibodies can be expressed in cells deficient or lacking the ability of to fucosylate. In a specific example, cell lines with a knockout of both alleles of α1,6-fucosyltransferase can be used to produce antibodies or antigen-binding fragments thereof with reduced fucose content. The Potelligent® system (Lonza) is an example of such a system that can be used to produce antibodies or antigen-binding fragments thereof with reduced fucose content.

For long-term, high-yield production of recombinant proteins, stable expression cells can be generated. For example, cell lines which stably express an anti-GITR antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161) or an antigen-binding fragment thereof can be engineered. In specific embodiments, a cell provided herein stably expresses a light chain/light chain variable domain and a heavy chain/heavy chain variable domain which associate to form an antibody described herein (e.g., an antibody comprising the CDRs of any one of antibodies Hum231#1, Hum231#2, pab1964, pab1965, pab1966, pab1967, pab1968, pab1969, pab1970, pab1971, pab1972, pab1973, pab1975, pab1976, pab1977, pab1979, pab1980, pab1981, pab1983, 231-32-15 or antibodies 1-107, or antibodies pab2159, pab2160, or pab2161) or an antigen-binding fragment thereof.

In certain aspects, rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA/polynucleotide, engineered cells can be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method can advantageously be used to engineer cell lines which express an anti-GITR antibody described herein or a fragment thereof. Such engineered cell lines can be particularly useful in screening and evaluation of compositions that interact directly or indirectly with the antibody molecule.

A number of selection systems can be used, including but not limited to, the herpes simplex virus thymidine kinase (Wigler M et al., (1977) Cell 11(1): 223-32), hypoxanthineguanine phosphoribosyltransferase (Szybalska E H & Szybalski W (1962) PNAS 48(12): 2026-2034) and adenine phosphoribosyltransferase (Lowy I et al., (1980) Cell 22(3): 817-23) genes can be employed in tk-, hgprt- or aprt-cells, respectively. Also, antimetabolite resistance can be used as the basis of selection for the following genes: dhfr, which confers resistance to methotrexate (Wigler M et al., (1980) PNAS 77(6): 3567-70; O'Hare K et al., (1981) PNAS 78: 1527-31); gpt, which confers resistance to mycophenolic acid (Mulligan R C & Berg P (1981) PNAS 78(4): 2072-6); neo, which confers resistance to the aminoglycoside G-418 (Wu G Y & Wu C H (1991) Biotherapy 3: 87-95; Tolstoshev P (1993) Ann Rev Pharmacol Toxicol 32: 573-596; Mulligan R C (1993) Science 260: 926-932; and Morgan R A & Anderson W F (1993) Ann Rev Biochem 62: 191-217; Nabel G J & Felgner P L (1993) Trends Biotechnol 11(5): 211-5); and hygro, which confers resistance to hygromycin (Santerre R F et al., (1984) Gene 30(1-3): 147-56). Methods commonly known in the art of recombinant DNA technology can be routinely applied to select the desired recombinant clone and such methods are described, for example, in Ausubel F M et al., (eds.), Current Protocols in Molecular Biology, John Wiley & Sons, NY (1993); Kriegler M, Gene Transfer and Expression, A Laboratory Manual, Stockton Press, NY (1990); and in Chapters 12 and 13, Dracopoli N C et al., (eds.), Current Protocols in Human Genetics, John Wiley & Sons, NY (1994); Colbère-Garapin F et al., (1981) J Mol Biol 150: 1-14, which are incorporated by reference herein in their entireties.

The expression levels of an antibody molecule can be increased by vector amplification (for a review, see Bebbington C R & Hentschel C C G, The use of vectors based on gene amplification for the expression of cloned genes in mammalian cells in DNA cloning, Vol. 3 (Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse G F et al., (1983) Mol Cell Biol 3: 257-66).

The host cell can be co-transfected with two or more expression vectors described herein, the first vector encoding a heavy chain derived polypeptide and the second vector encoding a light chain derived polypeptide. The two vectors can contain identical selectable markers which enable equal expression of heavy and light chain polypeptides. The host cells can be co-transfected with different amounts of the two or more expression vectors. For example, host cells can be transfected with any one of the following ratios of a first expression vector and a second expression vector: 1:1, 1:2, 1:3, 1:4, 1:5, 1:6, 1:7, 1:8, 1:9, 1:10, 1:12, 1:15, 1:20, 1:25, 1:30, 1:35, 1:40, 1:45, or 1:50.

Alternatively, a single vector can be used which encodes, and is capable of expressing, both heavy and light chain polypeptides. In such situations, the light chain should be placed before the heavy chain to avoid an excess of toxic free heavy chain (Proudfoot N J (1986) Nature 322: 562-565; and Köhler G (1980) PNAS 77: 2197-2199). The coding sequences for the heavy and light chains can comprise cDNA or genomic DNA. The expression vector can be monocistronic or multicistronic. A multicistronic nucleic acid construct can encode 2, 3, 4, 5, 6, 7, 8, 9, 10 or more, or in the range of 2-5, 5-10 or 10-20 genes/nucleotide sequences. For example, a bicistronic nucleic acid construct can comprise in the following order a promoter, a first gene (e.g., heavy chain of an antibody described herein), and a second gene and (e.g., light chain of an antibody described herein). In such an expression vector, the transcription of both genes can be driven by the promoter, whereas the translation of the mRNA from the first gene can be by a cap-dependent scanning mechanism and the translation of the mRNA from the second gene can be by a cap-independent mechanism, e.g., by an IRES.

Once an antibody molecule described herein has been produced by recombinant expression, it can be purified by any method known in the art for purification of an immunoglobulin molecule, for example, by chromatography (e.g., ion exchange, affinity, particularly by affinity for the specific antigen after Protein A, and sizing column chromatography), centrifugation, differential solubility, or by any other standard technique for the purification of proteins. Further, the antibodies described herein can be fused to heterologous polypeptide sequences described herein or otherwise known in the art to facilitate purification.

In specific embodiments, an antibody or an antigen-binding fragment thereof described herein is isolated or purified. Generally, an isolated antibody is one that is substantially free of other antibodies with different antigenic specificities than the isolated antibody. For example, in a particular embodiment, a preparation of an antibody described herein is substantially free of cellular material and/or chemical precursors. The language "substantially free of cellular material" includes preparations of an antibody in which the antibody is separated from cellular components of the cells from which it is isolated or recombinantly produced. Thus, an antibody that is substantially free of cellular material includes preparations of antibody having less than about 30%, 20%, 10%, 5%, 2%, 1%, 0.5%, or 0.1% (by dry weight) of heterologous protein (also referred to herein as a "contaminating protein") and/or variants of an antibody, for example, different post-translational modified forms of an antibody or other different versions of an antibody (e.g., antibody fragments). When the antibody is recombinantly produced, it is also generally substantially free of culture medium, i.e., culture medium represents less than about 20%, 10%, 2%, 1%, 0.5%, or 0.1% of the volume of the protein preparation. When the antibody is produced by chemical synthesis, it is generally substantially free of chemical precursors or other chemicals, i.e., it is separated from chemical precursors or other chemicals which are involved in the synthesis of the protein. Accordingly, such preparations of the antibody have less than about 30%, 20%, 10%, or 5% (by dry weight) of chemical precursors or compounds other than the antibody of interest. In a specific embodiment, antibodies described herein are isolated or purified.

5.3 Pharmaceutical Compositions

Provided herein are compositions comprising an antibody or antigen-binding fragment thereof described herein having the desired degree of purity in a physiologically acceptable carrier, excipient or stabilizer (Remington's Pharmaceutical Sciences (1990) Mack Publishing Co., Easton, Pa.). Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

In a specific embodiment, pharmaceutical compositions comprise an antibody or antigen-binding fragment thereof described herein, and optionally one or more additional prophylactic or therapeutic agents, in a pharmaceutically acceptable carrier. In a specific embodiment, pharmaceutical compositions comprise an effective amount of an antibody or antigen-binding fragment thereof described herein, and optionally one or more additional prophylactic of therapeutic agents, in a pharmaceutically acceptable carrier. See Section 5.4, infra, for examples of prophylactic or therapeutic agents. In some embodiments, the antibody is the only active ingredient included in the pharmaceutical composition. Pharmaceutical compositions described herein can be useful in enhancing, inducing or activating a GITR activity and treating a condition, such as cancer and an infectious disease.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylceluose, hydroxypropyl methylcellulose and polyvinylpyrrolidone. Emulsifying agents include Polysorbate 80 (TWEEN® 80). A sequestering or chelating agent of metal ions includes EDTA. Pharmaceutical carriers also include ethyl alcohol, polyethylene glycol and propylene glycol for water miscible vehicles; and sodium hydroxide, hydrochloric acid, citric acid or lactic acid for pH adjustment.

A pharmaceutical composition may be formulated for any route of administration to a subject. Specific examples of routes of administration include intranasal, oral, pulmonary, transdermal, intradermal, and parenteral. Parenteral administration, characterized by either subcutaneous, intramuscular or intravenous injection, is also contemplated herein. Injectables can be prepared in conventional forms, either as liquid solutions or suspensions, solid forms suitable for solution or suspension in liquid prior to injection, or as emulsions. The injectables, solutions and emulsions also contain one or more excipients. Suitable excipients are, for example, water, saline, dextrose, glycerol or ethanol. In addition, if desired, the pharmaceutical compositions to be administered can also contain minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Preparations for parenteral administration of an antibody include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous.

If administered intravenously, suitable carriers include physiological saline or phosphate buffered saline (PBS), and solutions containing thickening and solubilizing agents, such as glucose, polyethylene glycol, and polypropylene glycol and mixtures thereof Topical mixtures comprising an antibody are prepared as described for the local and systemic administration. The resulting mixture can be a solution, suspension, emulsions or the like and can be formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

An antibody or antigen-binding fragment thereof described herein can be formulated as an aerosol for topical application, such as by inhalation (see, e.g., U.S. Pat. Nos. 4,044,126, 4,414,209 and 4,364,923, which describe aerosols for delivery of a steroid useful for treatment of inflammatory diseases, particularly asthma). These formulations for administration to the respiratory tract can be in the form of an aerosol or solution for a nebulizer, or as a microfine powder for insufflations, alone or in combination with an inert carrier such as lactose. In such a case, the particles of the formulation will, in one embodiment, have diameters of less than 50 microns, in one embodiment less than 10 microns.

An antibody or antigen-binding fragment thereof described herein can be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the antibody alone or in combination with other pharmaceutically acceptable excipients can also be administered.

Transdermal patches, including iontophoretic and electrophoretic devices, are well known to those of skill in the art, and can be used to administer an antibody. For example, such patches are disclosed in U.S. Pat. Nos. 6,267,983, 6,261,595, 6,256,533, 6,167,301, 6,024,975, 6,010715, 5,985,317, 5,983,134, 5,948,433, and 5,860,957.

In certain embodiments, a pharmaceutical composition comprising an antibody or antigen-binding fragment thereof described herein is a lyophilized powder, which can be reconstituted for administration as solutions, emulsions and other mixtures. It may also be reconstituted and formulated as solids or gels. The lyophilized powder is prepared by dissolving an antibody or antigen-binding fragment thereof described herein, or a pharmaceutically acceptable derivative thereof, in a suitable solvent. In some embodiments, the lyophilized powder is sterile. The solvent may contain an excipient which improves the stability or other pharmacological component of the powder or reconstituted solution, prepared from the powder. Excipients that may be used include, but are not limited to, dextrose, sorbitol, fructose, corn syrup, xylitol, glycerin, glucose, sucrose or other suitable agent. The solvent may also contain a buffer, such as citrate, sodium or potassium phosphate or other such buffer known to those of skill in the art at, in one embodiment, about neutral pH. Subsequent sterile filtration of the solution followed by lyophilization under standard conditions known to those of skill in the art provides the desired formulation. In one embodiment, the resulting solution will be apportioned into vials for lyophilization. Each vial will contain a single dosage or multiple dosages of the compound. The lyophilized powder can be stored under appropriate conditions, such as at about 4° C. to room temperature.

Reconstitution of this lyophilized powder with water for injection provides a formulation for use in parenteral administration. For reconstitution, the lyophilized powder is added to sterile water or other suitable carrier. The precise amount depends upon the selected compound. Such amount can be empirically determined.

The antibodies or antigen-binding fragments thereof described herein and other compositions provided herein can also be formulated to be targeted to a particular tissue, receptor, or other area of the body of the subject to be treated. Many such targeting methods are well known to those of skill in the art. All such targeting methods are contemplated herein for use in the instant compositions. For non-limiting examples of targeting methods, see, e.g., U.S. Pat. Nos. 6,316,652, 6,274,552, 6,271,359, 6,253,872, 6,139,865, 6,131,570, 6,120,751, 6,071,495, 6,060,082, 6,048,736, 6,039,975, 6,004,534, 5,985,307, 5,972,366, 5,900,252, 5,840,674, 5,759,542 and 5,709,874. In a specific embodiment, an antibody or antigen-binding fragment thereof described herein is targeted to a tumor.

The compositions to be used for in vivo administration can be sterile. This is readily accomplished by filtration through, e.g., sterile filtration membranes.

5.4 Uses and Methods 5.4.1 Therapeutic Uses and Methods

In one aspect, presented herein are methods for modulating one or more immune functions or responses in a subject, comprising to a subject in need thereof administering an anti-GITR antibody or antigen-binding fragment thereof described herein, or a composition thereof. In a specific aspect, presented herein are methods for activating, enhancing or inducing one or more immune functions or responses in a subject, comprising to a subject in need thereof administering an anti-GITR antibody or antigen-binding fragment thereof, or a composition thereof. In a specific embodiment, presented herein are methods for preventing and/or treating diseases in which it is desirable to activate or enhance one or more immune functions or responses, comprising administering to a subject in need thereof an anti-GITR antibody or antigen-binding fragment thereof described herein or a composition thereof. In other specific embodiments, the method comprises combination therapy, wherein the anti-GITR antibody or antigen-binding fragment thereof is administered to a subject in combination with another therapy, such as those described below, to activate or enhance one or more immune functions or responses. In certain embodiments, the anti-GITR antibody or antigen-binding fragment thereof is administered as an adjuvant in combination with an antigenic composition. In certain embodiments, the antigenic composition comprises a cancer or tumor antigen (e.g., the bcr/abl antigen in leukemia, HPVE6 and E7 antigens of the oncogenic virus associated with cervical cancer, the MAGE1 and MZ2-E antigens in or associated with melanoma, or the MVC-1 and HER-2 antigens in or associated with breast cancer). In some embodiments, the antigenic composition comprises an antigen derived from a pathogen (e.g., a viral antigen, parasitic antigen, bacterial antigen or fungal antigen). Examples of viral antigens include the nucleoprotein (NP) of influenza virus, HIV antigens (e.g., gag proteins of HIV, HIV env protein (e.g., gp120 and/or gp41), HIV Nef protein, HIV Pol proteins, HIV reverse transcriptase, or HIV protease), Ebola virus (EBOV) antigens (e.g., EBOV NP or glycoprotein), small pox antigens, hepatitis A, B or C virus antigens, human rhinovirus antigens, Herpes simplex virus antigens, poliovirus antigens, foot-and-mouth disease virus (FMDV) antigens, rabies virus antigens, rotavirus antigens, coxsackie virus antigens, and human papilloma virus (HPV) antigens. Examples of bacterial antigens include *Bordetella pertussis* (e.g., P69 protein and filamentous haemagglutinin (FHA) antigens), *Vibrio cholerae, Bacillus anthracis*, and *E. coli* antigens such as *E. coli* heat Labile toxin B subunit (LT-B), *E. coli* K88 antigens, and enterotoxigenic *E. coli* antigens.

As used herein, the term "in combination" refers to the use of more than one therapy (e.g., one or more prophylactic and/or therapeutic agents). The use of the term "in combination" does not restrict the order in which therapies are administered to a subject with a disease or disorder, or the route of administration. A first therapy (e.g., a prophylactic or therapeutic agent) can be administered prior to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second therapy (e.g., a prophylactic or therapeutic agent) to a subject with a disease or disorder or a symptom thereof. In certain embodiments, a therapy (e.g., an agent) administered in combination with an anti-GITR antibody or antigen-binding fragment thereof to a subject is administered in the same composition (e.g., pharmaceutical composition). In other embodiments, a therapy (e.g., an agent) administered in combination with an anti-GITR antibody or antigen-binding fragment thereof is administered to a subject in a different composition (e.g., two or more pharmaceutical compositions). The two compositions may be administered at the same or different times and/or by the same or different routes of administration. In a particular embodiment, an anti-GITR antibody or antigen-binding fragment thereof described herein is administered to a subject in combination with a vaccine composition to induce, activate or enhance the immune response elicited by the vaccine composition. In one embodiment, the vaccine composition is a cancer vaccine. A cancer vaccine is an agent, molecule, or immunogen which stimulates or elicits an endogenous immune response in an individual or subject against one or more cancer antigens. The cancer antigen can be a tumor associated peptide, or protein that induces or enhances immune response and is derived from tumor associated genes and encoded proteins including, for example, MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-A13, GAGE-1, GAGE-2, GAGE-3, GAGE-4, GAGE-5, GAGE-6, GAGE-7, GAGE-8, BAGE-1, RAGE-1, LB33/MUM-1, PRAME, NAG, MAGE-Xp2 (MAGE-B2), MAGEXp3 (MAGE-B3), MAGE-Xp4 (AGE-B4), tyrosinase, brain glycogen phosphorylase, Melan-A, MAGE-C1, MAGE-C2, NY-ESO-1, LAGE-1, SSX-1, SSX-2(HOM-MEL-40), SSX-1, SSX-4, SSX-5, SCP-1, CT-7, alpha-actinin-4, Bcr-Abl fusion protein, Casp-8, beta-catenin, cdc27, cdk4, cdkn2a, coa-1, dek-can fusion protein, EF2, ETV6-AML1 fusion protein, LDLR-fucosyltransferaseAS fusion protein, HLA-A2, HLA-A11, hsp70-2, KIAAO205, Mart2, Mum-2, and 3, neo-PAP, myosin class I, OS-9, pml-RARαfusion protein, PTPRK, K-ras, N-ras, Triosephosphate isomeras, GnTV, Herv-K-mel, Lage-1, Mage-C2, NA-88, Mage-2, SP17, and TRP2-Int2, (MART-I), gp100 (Pmel 17), TRP-1, TRP-2, MAGE-1, MAGE-3, p15(58), CEA, NY-ESO (LAGE), SCP-1, Hom/Mel-40, p53, H-Ras, HER-2/neu, BCR-ABL, E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, beta-Catenin, CDK4, Mum-1, p16, TAGE, PSMA, PSCA, CT7, telomerase, 43-9F, 5T4, 791Tgp72, .alpha.-fetoprotein, 13HCG, BCA225, BTAA, CA 125, CA 15-3 (CA 27.29\BCAA), CA 195, CA 242, CA-50, CAM43, CD68\KP1, CO-029, FGF-5, G250, Ga 733 (EpCAM), HTgp-175, M344, MA-50, MG7-Ag, MOV18, NB\170K, NYCO-1, RCAS1, SDCCAG16, TA-90 (Mac-2 binding protein\cyclophilin C-associated protein), TAAL6, TAG72, TLP, and TPS. Cancer vaccines are useful to either increase recognition of cancer cells by the immune system or enhance the anti-tumor response through lymphocyte activation. Effector T cells have been successfully generated by immunization with intact tumor cells or extract, purified antigens, use of peptides optimized for binding to both MHC and TcR, immune dominant peptides, DNA encoding tumor antigens, recombinant viruses encoding tumor antigens or antigen pulsed antigen-presenting cells. In some embodiments, enhancement of immune recognition and cell expansion may be improved by the use of co-stimulators and cytokines, injection of vectors to express cytokines, in vitro antigen-pulsed and activated autologous dendritic cells and by blocking negative modulators (e.g., using immune checkpoint targeting agents) and by depleting T-regulatory cells.

In a specific embodiment, an anti-GITR antibody or antigen-binding fragment thereof described herein is administered to a subject in combination with a heat shock protein based tumor vaccine or a heat shock protein based pathogen vaccine. See Sections 5.4.1.1 and 5.4.1.2 below regarding heat shock protein based tumor vaccines or heat shock protein based pathogen vaccines for use in combination with an anti-GITR antibody or antigen-binding fragment thereof described herein.

In a particular embodiment, an anti-GITR antibody or antigen-binding fragment thereof described herein is administered in combination with an adjuvant to induce, activate or enhance the agonistic effects of the anti-GITR antibody. Various adjuvants can be used depending on the treatment context. Non-limiting examples of appropriate adjuvants include, for example, Complete Freund's Adjuvant (CFA), Incomplete Freund's Adjuvant (IFA), motanide ISA (incomplete seppic adjuvant), the Ribi adjuvant system (RAS), Titer Max, muramyl peptides, Syntex Adjuvant Formulation (SAF), alum (aluminum hydroxide and/or aluminum phosphate), aluminum salt adjuvants, Gerbu® adjuvants, nitrocellulose absorbed antigen, encapsulated or entrapped antigen, immuno-stimulating complexes such as saponins, Quil A, QS-21 and others. Other adjuvants include CpG oligonucleotides and double stranded RNA molecules, such as poly(A), poly(U). Combinations of the above adjuvants may also be used. In some embodiments, one or more adjuvants are a saponin, such as QS-21, QS-21 and 3 De-O-acylated monophosphoryl lipid A (3 D-MPL), and immunostimulatory oligonucleotides and saponin adjuvants as disclosed in U.S. Pat. Nos. 6,645,495; 7,029,678 and 7,858,589, respectively.

In certain embodiments, provided herein are methods for enhancing the stimulation of GITR-responsive cells (e.g., T cells, such as effector T-cells) comprising incubating ex vivo the GITR-responsive cells (e.g., T cells) with an antibody or antigen-binding fragment thereof described herein. In some embodiments, the GITR-responsive cells are incubated with a stimulating agent (e.g., phytohaemagglutinin (PHA) and/or phorbol myristate acetate (PMA), or a TCR complex stimulating antibody, such as an anti-CD3 antibody and anti-CD28 antibody) prior to, simultaneously with or subsequent to the incubation with the anti-GITR antibody or antigen-binding fragment thereof. In certain embodiments, the GITR-responsive cells (e.g., T cells) were isolated from a subject (e.g., a human). In some embodiments, the GITR-responsive cells following stimulation with the anti-GITR antibody or antigen binding fragment thereof are administered to a subject (e.g., a human). The GITR-response cells (e.g., T cells) may be administered to the same or a different subject than the cells were originally isolated from.

In some embodiments, provided herein are methods for activating GITR-responsive cells (e.g., T cells) comprising incubating the GITR-responsive cells (e.g., T cells) with an antibody or antigen-binding fragment thereof described herein. In certain embodiments, the GITR-responsive cells are incubated with a stimulating agent (e.g., a T cell receptor complex stimulating agent such as, e.g., phytohaemagglutinin (PHA) and/or phorbol myristate acetate (PMA), or a TCR complex stimulating antibody, such as an anti-CD3 antibody and anti-CD28 antibody) prior to, simultaneously with or subsequent to the incubation with the anti-GITR antibody or antigen-binding fragment thereof. In some embodiments, the GITR-responsive cells (e.g., T cells) were isolated from a subject (e.g., a human). In certain embodiments, the GITR-responsive cells following activation with the anti-GITR antibody or antigen-binding fragment thereof are administered to a subject (e.g., a human). The GITR-responsive cells (e.g., T cells) may be administered to the same or a different subject than the cells were originally isolated from.

In some embodiments, cells responsive to GITR (i.e., GITR-responsive cells) are incubated in cell culture with an anti-GITR antibody or antigen-binding fragment thereof described herein, and administered to a subject to enhance immune function (e.g., to enhance the expansion/proliferation of GITR-responsive cells, such as T cells, and/or enhance T cell effector function) and/or to treat cancer and/or prevent or treat an infectious disease. Examples of cancers and infectious diseases are provided herein. See, e.g., Example 7 below for exemplary methods. In specific embodiments, the GITR-responsive cells are effector T cells (e.g., CD4$^+$ and CD8$^+$). In some embodiments, the GITR-responsive cells are isolated from a subject. In some embodiments, the GITR-responsive cells are assessed for GITR expression prior to incubation with an anti-GITR antibody or antigen-binding fragment thereof described herein. In certain embodiments, the GITR-responsive cells are incubated with a mitogen (e.g., a T cell mitogen, such as, e.g., phytohaemagglutinin (PHA) and/or phorbol myristate acetate (PMA), or a TCR complex stimulating antibody, such as an anti-CD3 antibody and anti-CD28 antibody) prior to, simultaneously with or subsequent to the incubation with an anti-GITR antibody or antigen-binding fragment thereof described herein. The GITR responsive cells may be incubated with an anti-GITR antibody or antigen-binding fragment thereof described herein for, e.g., 5 minutes, 10 minutes, 15 minutes, 30 minutes, 45 minutes, 1 hour, 2 hours, 3 hours, 4 hours, 5 hours, 6 hours, 8 hours, 12 hours, 18 hours, 24 hours or more. In certain embodiments, the GITR-responsive cells which are administered to a subject were derived from the subject (i.e., the GITR-responsive cells are autologous). In other embodiments, the GITR-responsive cells which are administered to a subject were derived from a different subject. The GITR-responsive cells following incubation with anti-GITR antibody or antigen-binding fragment thereof may be administered locally or systemically to a subject via any route known to one of skill in the art (e.g., parenteral administration, such as subcutaneous, intravenous, or intramuscular administration, or intratumoral administration). In certain embodiments, a suitable dose of GITR-responsive cells following incubation with anti-GITR antibody or an antigen-binding fragment thereof administered to subject may be at least 100, 200, 300, 400, 500, 700, 1,000, 5,000, 10,000, 25,000, 50,000, 100,000, 1×10$^6$, 1×10$^7$, or 1×10$^8$ cells. The GITR-responsive cells following incubation with anti-GITR antibody or antigen-binding fragment thereof may be administered 1, 2, 3, 4, 5, 6, 7, 8 or more times. The frequency and dose of GITR-responsive cells following incubation with anti-GITR antibody or antigen-binding fragment thereof which are administered to a subject will vary depending on several factors, including, e.g., the condition of the patient. In another embodiment, provided herein is a method for enhancing the expansion of T cells (e.g., CD4$^+$ and/or CD8$^+$ T cells) in a subject, comprising administering to the subject an effective amount of an antibody or antigen-binding fragment thereof described herein, or a pharmaceutical composition described herein. In another embodiment, provided herein is a method for enhancing the expansion of CD8$^+$ T cells in a subject, comprising administering to the subject an effective amount of an antibody or antigen-binding fragment thereof described herein, or a pharmaceutical composition described herein. In another embodiment, provided herein is a method for enhancing the expansion of CD4$^+$ T cells in a subject, comprising administering to the subject an effective amount of an antibody or antigen-binding fragment thereof described herein, or a pharmaceutical composition described herein. In a specific embodiment, the subject is human.

In another embodiment, provided herein is a method for enhancing the expansion of T cells (e.g., CD4$^+$ and/or CD8$^+$ T cells) and/or T cell effector function in a subject, comprising administering to the subject an effective amount of an antibody or antigen-binding fragment thereof described herein, or a pharmaceutical composition described herein. In another embodiment, provided herein is a method for enhancing the expansion of CD8$^+$ T cells and/or T cell effector function in a subject, comprising administering to the subject an effective amount of an antibody or antigen-binding fragment thereof described herein, or a pharmaceutical composition described herein. In another embodiment, provided herein is a method for enhancing the expansion of CD4$^+$ T cells and/or T cell effector function in a subject, comprising administering to the subject an effective amount of an antibody or antigen-binding fragment thereof described herein, or a pharmaceutical composition described herein. In a specific embodiment, the subject is human.

In another embodiment, provided herein is a method for preferential expansion of effector T-cells over the expansion of T-regulatory cells, comprising incubating ex vivo T-cells with an antibody or antigen-binding fragment thereof described herein. In certain embodiments, the anti-GITR antibody or antigen-binding fragment thereof expands effector T-cells over T-regulatory cells by 10%, 15%, 20%, 25%, 30%, 35%, 40%, 45%, 50%, 55%, 60%, 65%, 70%, 75%, 80% or greater. In some embodiments, the anti-GITR antibody or antigen-binding fragment thereof expands effector T-cells over T-regulatory cells by 10% to 20%, 15% to 25%, 25% to 50%, 30% to 60%, 50% to 75% or 65% to 85%. The effector T-cells and T-regulatory cells can be distinguished from each other by cell surface markers, such as those disclosed in the examples infra. In some embodiments, the T-cells were isolated from a subject (e.g., a human). In certain embodiments, the T-cells after expansion are administered to a subject (e.g., a human).

In another embodiment, provided herein is a method for preferential expansion of effector T-cells over the expansion of T-regulatory cells in a subject, comprising administering to the subject an effective amount of an antibody or antigen-binding fragment thereof described herein, or a composition thereof. In certain embodiments, the anti-GITR antibody or antigen-binding fragment thereof expands effector T-cells over T-regulatory cells by 10%, 15%, 20%, 25%, 30%, 35%, 40%, 45%, 50%, 55%, 60%, 65%, 70%, 75%, 80% or greater. In some embodiments, the anti-GITR antibody or antigen-binding fragment thereof expands effector T-cells over T-regulatory cells by 10% to 20%, 15% to 25%, 25% to 50%, 30% to 60%, 50% to 75% or 65% to 85%. The effector T-cells and T-regulatory cells can be distinguished from each other by cell surface markers and/or intracellular markers, such as those disclosed in the examples infra. In a specific embodiment, the subject is human.

In certain embodiments, treatment of a subject with an anti-GITR antibody or antigen-binding fragment described herein, or a composition thereof achieves one, two, three, four or more of the following effects: (i) reduction or amelioration of the severity of a disease or symptom associated therewith; (ii) reduction in the duration of a symptom associated with a disease; (iii) inhibition of the progression of a disease or symptom associated therewith; (iv) regression of a disease or symptom associated therewith; (v) prevention of the development or onset of a symptom associated with a disease that is present in the patient; (vi) inhibition of the recurrence of a symptom associated with a disease; (vii) reduction in the hospitalization of a subject; (viii) reduction in the hospitalization length; (ix) an increase in the survival of a subject with a disease; (x) a reduction in the number of symptoms associated with a disease; and (xi) an enhancement, improvement, supplementation, complementation or augmentation of the therapeutic effect(s) of another therapy. In an alternative embodiment, an anti-GITR antibody or antigen-binding fragment thereof is used to prevent a disorder, such as an infectious disease.

In some embodiments, an anti-GITR antibody or antigen-binding fragment thereof, or a composition thereof is administered to a subject in combination with an immunotherapeutic agent. Immunotherapeutic agents for use in the combination therapies disclosed herein include, but are not limited to, a Her2/neu receptor antibody such as trastuzumab (marketed as Herceptin®), an anti-CD52 antibody such as alemtuzumab (marketed as Campath®. MabCampath® or Campath-1H), an anti-CD33 antibody such as gemtuzumab linked to calicheamicin (marketed as Mylotarg®), an anti-CD20 antibody such as rituximab (marketed as Rituxan® and MabThera®), Ibritumomab tiuxetan (marketed as Zevalin®), anti-TNFα antibodies such as infliximab (marketed as Remicade®) or adalimmumab (marketed as Humira), a soluble TNFR2 molecule such as etanercept (marketed as Enbrel®), an antibody to the CD25 chain of the IL-2 receptor such as basiliximab (marketed as Simulect®), an anti-CD40/CD4OL antibody such as humanized $IgG_1$ anti-human CD40 antibody (SGN-40), Toll-like receptor agonists such as monophosphoril lipid A (MPL®), CpG, single-stranded RNA, nucleotides, nucleotide analogue, CL087 (a TLR7-specific ligand), loxoribine, polyinosinepolycytidylic acid, flagellin, resiquimod, immiquimod, gardiquimod, NOD ligands such as muramyl dipeptide, murabutide, peptidoglycan and muramyldipeptide, CD1d agonists, such as a-galactosyl ceramide (α-GalCer) and threitol ceramide (ThrCer), an antibody such as Fresolimumab® (GC1008), an antibody targeting an inhibiting TGF-beta isoforms 1, 2 or 3, an Fc fusion, Dalantercept (Alk-Fc), and the small molecule LY2157299 (receptor kinase inhibitor).

Diseases that can be treated by an enhancement of immune function include cancer and infectious diseases. Various cancers and infectious diseases are described below. In a specific embodiment, an anti-GITR antibody or antigen-binding fragment thereof described herein can be used to treat a condition associated with cancer or a condition resulting from the administration of an anti-cancer therapy (such as, e.g., chemotherapy or radiation). In a particular embodiment, an anti-GITR antibody or antigen-binding fragment thereof can be used to treat or manage lymphocytopenia. In another embodiment, an anti-GITR antibody or antigen-binding fragment thereof is administered to a patient diagnosed with cancer to increase the proliferation and/or effector function of one or more immune cell populations (e.g., T cell effector cells, such as $CD4^+$ and $CD8^+$ T cells) in the patient.

In a specific embodiment, an anti-GITR antibody or antigen-binding fragment thereof described herein activates or enhances or induces one or more immune functions or responses in a subject by at least 99%, at least 98%, at least 95%, at least 90%, at least 85%, at least 80%, at least 75%, at least 70%, at least 60%, at least 50%, at least 45%, at least 40%, at least 45%, at least 35%, at least 30%, at least 25%, at least 20%, or at least 10%, or in the range of between 10% to 25%, 25% to 50%, 50% to 75%, or 75% to 95% relative to the immune function in a subject not administered the anti-GITR antibody or antigen-binding fragment thereof described herein using assays well known in the art, e.g., ELISPOT, ELISA, and cell proliferation assays. In a specific embodiment, the immune function is cytokine production (e.g., interferon-gamma, IL-2, IL-5, IL-10, IL-12, or transforming growth factor (TGF)-alpha production). In another embodiment, the immune function is T cell proliferation/expansion, which can be assayed, e.g., by flow cytometry to detect the number of cells expressing markers of T cells (e.g., CD3, CD4, or CD8). In another embodiment, the immune function is antibody production, which can be assayed, e.g., by ELISA. In some embodiments, the immune function is effector function, which can be assayed, e.g., by a cytotoxicity assay or other assays well known in the art. In another embodiment, the immune function is a Th1 response. In another embodiment, the immune function is a Th2 response. In another embodiment, the immune function is a memory response.

In specific embodiments, non-limiting examples of immune functions that may be enhanced or induced by an anti-GITR antibody or antigen-binding fragment thereof are proliferation/expansion of effector lymphocytes (e.g., increase in the number of effector T lymphocytes), inhibition of apoptosis of effector lymphocytes (e.g., effector T lymphocytes), and suppression of Tregs. In particular embodiments, an immune function enhanced or induced by an anti-GITR antibody or antigen-binding fragment thereof described herein is proliferation/expansion in the number of or activation of $CD4^+$ T cells (e.g., Th1 and Th2 helper T cells), $CD8^+$ T cells (e.g., cytotoxic T lymphocytes, alpha/beta T cells, and gamma/delta T cells), B cells (e.g., plasma cells), memory T cells, memory B cells, tumor-resident T cells, $CD122^+$ T cells, natural killer (NK) cells), macrophages, monocytes, dendritic cells, mast cells, eosinophils, basophils or polymorphonucleated leukocytes. In one embodiment, an anti-GITR antibody or antigen-binding fragment thereof described herein activates or enhances the proliferation/expansion or number of lymphocyte progenitors. In some embodiments, an anti-GITR antibody or antigen-binding fragment thereof described herein increases the number of $CD4^+$ T cells (e.g., Th1 and Th2 helper T cells), $CD8^+$ T cells (e.g., cytotoxic T lymphocytes, alpha/beta T cells, and gamma/delta T cells), B cells (e.g., plasma cells), memory T cells, memory B cells, tumor-resident T cells, $CD122^+$ T cells, natural killer cells (NK cells), macrophages, monocytes, dendritic cells, mast cells, eosinophils, basophils or polymorphonucleated leukocytes by approximately at least 99%, at least 98%, at least 95%, at least 90%, at least 85%, at least 80%, at least 75%, at least 70%, at least 60%, at least 50%, at least 45%, at least 40%, at least 45%, at least 35%, at least 30%, at least 25%, at least 20%, or at least 10%, or in the range of between 10% to 25%, 25% to 50%, 50% to 75%, or 75% to 95% relative a negative control (e.g., number of the respective cells not treated, cultured, or contacted with an anti-GITR antibody or antigen-binding fragment thereof described herein).

In particular embodiments, an antibody described herein, which immunospecifically binds to GITR (e.g., human GITR), induces, activates or enhances an activity of human GITR independent of TCR triggering. In specific embodiments, an antibody described herein, which immunospecifically binds to GITR (e.g., human GITR), induces, activates or enhances an activity of NF-κB independent of TCR triggering. In certain embodiments, the activity of NF-κB can be assessed in, e.g., an assay comprising the following steps: (a) incubating T cells (e.g., Jurkat cells) expressing a NF-κB-luciferase reporter construct (e.g., GloResponse NF-κB-luc2P construct) and GITR (e.g., human GITR) with the antibody described herein or an isotype control antibody at an antibody concentration of, e.g., 12.5, 10, 5, 2.5, 1.25, or 0.625 µg/ml, in the absence of an anti-CD3 antibody; and (b) reading luciferase signal after, e.g., 2, 5, 6, 8 or 18 hours of incubation using, e.g., an EnVision multilabel reader 2100, wherein a positive luciferase signal relative to the isotype control antibody indicates the activity of NF-κB. In a particular embodiment, the luciferase signal is read after 5 hours of incubation.

In another embodiment, provided herein is a method of activating T cells independent of TCR triggering comprising contacting T cells with an antibody or antigen-binding fragment thereof described herein. In particular embodiments, provided herein is a method of inducing, activating or enhancing an activity of NF-κB independent of TCR triggering comprising contacting T cells with an antibody or antigen-binding fragment thereof described herein. In certain embodiments, the activity of NF-κB can be assessed in, e.g., an assay comprising the following steps: (a) incubating T cells (e.g., Jurkat cells) expressing a NF-κB-luciferase reporter construct (e.g., GloResponse NF-κB-luc2P construct) and GITR (e.g., human GITR) with the antibody described herein or an isotype control antibody at an antibody concentration of, e.g., 12.5, 10, 5, 2.5, 1.25, or 0.625 µg/ml, in the absence of an anti-CD3 antibody; and (b) reading luciferase signal after, e.g., 2, 5, 6, 8 or 18 hours of incubation using, e.g., an EnVision multilabel reader 2100, wherein a positive luciferase signal relative to the isotype control antibody indicates the activity of NF-κB. In a particular embodiment, the luciferase signal is read after 5 hours of incubation.

In particular embodiments, provided herein is a method of increasing the percentage of polyfunctional (IFNγ+TNFα+) T cells comprising contacting T cells with an antibody or antigen-binding fragment thereof described herein. An increase in the percentage of polyfunctional (IFNγ+TNFα+) T cells can be assessed in, e.g., an assay comprising the following steps: (a) incubating, e.g., human PBMCs with, e.g., an anti-CD3 antibody at various suboptimal concentrations (e.g., 0.3-5 µg/ml); and, e.g., an antibody described herein, which immunospecifically binds to GITR (e.g., human GITR), at, e.g., 5 µg/ml or an isotype control antibody, for, e.g., 3-4 days at 37° C. and 5% $CO_2$; (b) treating cells with, e.g., Brefeldin A for, e.g., 6 hours at 37° C. and 5% $CO_2$; (c) staining the surface of the cells using, e.g., an anti-CD3 antibody, an anti-CD4 antibody, and an anti-CD8α antibody; (d) staining intracellularly using, e.g., an anti-IFNγ antibody and an anti-TNFα antibody; and (e) determining the percentage of polyfunctional (IFNγ+TNFα+) T cells relative to the isotype control antibody. In specific embodiments, the polyfunctional (IFNγ+TNFα+) T cells are selected from the group consisting of polyfunctional (IFNγ+TNFα+) CD4+ T cells and polyfunctional (IFNγ+TNFα+) CD8+ T cells.

In particular embodiments, provided herein is a method of increasing surface expression of OX40 and PD-1 in activated T cells comprising contacting T cells with an antibody or antigen-binding fragment thereof described herein. The surface expression of OX40 and PD-1 in activated T cells can be increased by at least about 1.2 fold, 1.3 fold, 1.4 fold, 1.5 fold, 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 30 fold, 40 fold, 50 fold, 60 fold, 70 fold, 80 fold, 90 fold, 100 fold, 200 fold, 300 fold, 400 fold, 500 fold, 600 fold, 700 fold, 800 fold, 900 fold, or 1000 fold as assessed by methods described herein and/or known to one of skill in the art, relative to surface expression of OX40 and PD-1 in activated T cells without the antibody described herein.

5.4.1.1 Cancer

In a specific aspect, presented herein are methods for treating cancer, comprising administering to a subject in need thereof an effective amount of an anti-GITR antibody or antigen-binding fragment thereof described herein or a composition thereof. In a specific embodiment, an anti-GITR antibody or antigen-binding fragment thereof described herein or a composition thereof is the only active agent administered to a subject.

The effect of an anti-GITR antibody or antigen-binding fragment thereof described herein on proliferation of cancer cells can be detected by routine assays, such as by assays that measure the uptake of radiolabeled thymidine. Alternatively, cell viability can be measured by assays that measure lactate dehydrogenase (LDH), a stable cytosolic enzyme that is released upon cell lysis, or by the release of [$^{51}$Cr] upon cell lysis. In one embodiment, necrosis measured by the ability or inability of a cell to take up a dye such as neutral red, trypan blue, or ALAMAR™ blue (Page B et al., (1993) Intl J Oncology 3: 473-6). In such an assay, the cells are incubated in media containing the dye, the cells are washed, and the remaining dye, reflecting cellular uptake of the dye, is measured spectrophotometrically.

In another embodiment, the dye is sulforhodamine B (SRB), whose binding to proteins can be used as a measure of cytotoxicity (Skehan P et al., (1990) J Nat Cancer Inst 82: 1107-12). In yet another embodiment, a tetrazolium salt, such as MTT, is used in a quantitative colorimetric assay for mammalian cell survival and proliferation by detecting living, but not dead, cells (see, e.g., Mosmann T (1983) J Immunol Methods 65: 55-63).

In other embodiments, apoptotic cells are measured in both the attached and "floating" compartments of the cultures. Both compartments are collected by removing the supernatant, trypsinizing the attached cells, and combining both preparations following a centrifugation wash step (10 minutes, 2000 rpm). The protocol for treating tumor cell cultures with sulindac and related compounds to obtain a significant amount of apoptosis has been described in the literature (see, e.g., Piazza G A et al., (1995) Cancer Res 55: 3110-6). Features of this method include collecting both floating and attached cells, identification of the optimal treatment times and dose range for observing apoptosis, and identification of optimal cell culture conditions.

In another embodiment, apoptosis is quantitated by measuring DNA fragmentation. Commercial photometric methods for the quantitative in vitro determination of DNA fragmentation are available. Examples of such assays, including TUNEL (which detects incorporation of labeled nucleotides in fragmented ) and ELISA-based assays, are described in Biochemica, (1999) 2: 34 37 (Roche Molecular Biochemicals). In yet another embodiment, apoptosis can be observed morphologically.

Cancer cell lines on which such assays can be performed are well known to those of skill in the art. Apoptosis, necrosis and proliferation assays can also be performed on primary cells, e.g., a tissue explant.

In specific embodiments, the administration of an anti-GITR antibody or antigen-binding fragment thereof described herein or a composition thereof to a subject with cancer (in some embodiments, an animal model for cancer) achieves at least one, two, three, four or more of the following effects: (i) the reduction or amelioration of the severity of one or more symptoms of cancer; (ii) the reduction in the duration of one or more symptoms associated with cancer; (iii) the prevention in the recurrence of a symptom associated with cancer; (iv) the reduction in hospitalization of a subject; (v) a reduction in hospitalization length; (vi) the increase in the survival of a subject; (vii) the enhancement or improvement of the therapeutic effect of another therapy; (viii) the inhibition of the development or onset of one or more symptoms associated with cancer; (ix) the reduction in the number of symptoms associated with cancer; (x) improvement in quality of life as assessed by methods well known in the art; (x) inhibition of the recurrence of a tumor; (xi) the regression of tumors and/or one or more symptoms associated therewith; (xii) the inhibition of the progression of tumors and/or one or more symptoms associated therewith; (xiii) a reduction in the growth of a tumor; (xiv) a decrease in tumor size (e.g., volume or diameter); (xv) a reduction in the formation of a newly formed tumor; (xvi) eradication, removal, or control of primary, regional and/or metastatic tumors; (xvii) a decrease in the number or size of metastases; (xviii) a reduction in mortality; (xix) an increase in relapse free survival; (xx) the size of the tumor is maintained and does not increase or increases by less than the increase of a tumor after administration of a standard therapy as measured by conventional methods available to one of skill in the art, such as magnetic resonance imaging (MRI), dynamic contrast-enhanced MRI (DCE-MRI), X-ray, and computed tomography (CT) scan, or a positron emission tomography (PET) scan; and/or (xxi) an increase in the length of remission in patients.

In certain embodiments, two or more different anti-GITR antibodies or antigen-binding fragments thereof described herein are administered to a subject. In some embodiments, an anti-GITR antibody or antigen-binding fragment thereof described herein is administered to a subject in combination with one or more other therapies, e.g., anti-cancer agents, cytokines, cellular vaccines or anti-hormonal agents, to treat cancer.

In a specific embodiment, an anti-GITR antibody or antigen-binding fragment thereof described herein is administered in combination with radiation therapy comprising, e.g., the use of x-rays, gamma rays and other sources of radiation to destroy the cancer cells. In specific embodiments, the radiation treatment is administered as external beam radiation or teletherapy wherein the radiation is directed from a remote source. In other embodiments, the radiation treatment is administered as internal therapy or brachytherapy wherein a radioactive source is placed inside the body close to cancer cells or a tumor mass. In one aspect, an anti-GITR antibody or antigen-binding fragment thereof described herein can activate or enhance the immune function or response in a cancer patient with a compromised immune system due to anti-cancer therapy.

In another embodiment, an anti-GITR antibody or antigen-binding fragment thereof described herein is administered to a subject in combination with chemotherapy. In an embodiment, an anti-GITR antibody or antigen-binding fragment thereof described herein can be used before, during or after radiation therapy or chemotherapy. Examples of chemotherapeutic agents include cyclophosphamide, methotrexate, cyclosporin A, leflunomide, cisplatin, ifosfamide, taxanes such as taxol and paclitaxol, topoisomerase I inhibitors (e.g., CPT 11, topotecan, 9 AC, and GG 211), gemcitabine, vinorelbine, oxaliplatin, 5-fluorouracil (5-FU), leucovorin, vinorelbine, temodal, cytochalasin B, gramicidin D, emetine, mitomycin, etoposide, tenoposide, vincristine, vinblastine, colchicin, doxorubicin, daunorubicin, dihydroxy anthracin dione, mitoxantrone, mithramycin, actinomycin D, 1 dehydrotestosterone, glucocorticoids, procaine, tetracaine, lidocaine, propranolol, and puromycin homologs, and cytoxan.

In one embodiment, an anti-GITR antibody or antigen-binding fragment thereof described herein is administered to a subject in combination with cyclophosphamide, e.g., a low dose of cyclophosphamide. Cyclophosphamide (Elostan, Cytoxan), is a chemotherapeutic agent that has an immunomodulatory function when used at low doses (e.g., up to 300 mg/m$^2$, 300 mg/m$^2$ or about 300 mg/m$^2$ when administered intravenously). Specifically, low doses of cyclophosphamide can reduce the number and proliferative capacity of regulatory T cells (Treg) (e.g., CD4+CD25+FoxP3+ cells or, alternatively, CD45+CD3+CD4+CD8−FOXP3+CD25hiCD127low cells) and modulate immune-suppressive networks. In some embodiments, the dosage of a cyclophosphamide administration is about 50 mg/m$^2$, 100 mg/m$^2$, 200 mg/m$^2$, 300 mg/m$^2$, 500 mg/m$^2$, or more. In some embodiments, the dosage of a cyclophosphamide administration is in a range of 10 mg/m$^2$ to 100 mg/m$^2$, 50 mg/m$^2$ to 200 mg/m$^2$, 50 mg/m$^2$ to 300 mg/m$^2$, 50 mg/m$^2$ to 500 mg/m$^2$. In some embodiments, cyclophosphamide is administered to the subject within 1 hour, 2 hours, 3 hours, 4 hours, 8 hours, 12 hours, 1 day, 5 days or more prior to or following an initial administration of an anti-GITR antibody or antigen-binding fragment thereof described herein. In some embodiments, anti-GITR antibody or antigen-binding fragment thereof described herein is used in combination with cyclophosphamide, e.g., low dose cyclophosphamide, for the treatment of metastatic renal cell carcinoma (RCC).

In one embodiment, an anti-GITR antibody or antigen-binding fragment thereof described herein is administered to a subject in combination with a Treg-inhibitory agent. Examples of Treg-inhibitory agents include Zenapax® (daclizumab) (Roche), which is a human anti-CD25 monoclonal antibody used, e.g., for inducing immune suppression in organ transplantation. Daclizumab blocks IL-2 binding to CD25, which is also a signal for the maintenance of Tregs. Another agent that inhibits Tregs is Sutent® (Sunitinib) (Pfizer) which is a small molecule, multi-targeted tyrosine kinase inhibitor approved for the treatment of renal cell carcinoma (RCC) and other cancers. Another agent that may inhibit Tregs is 1-Methyl-D-tryptophan (1-MT), a competitive inhibitor of indoleamine 2,3-dioxygenase (IDO). IDO is an immunosuppressive agent expressed in certain normal and neoplastic cells and may be associated with an increase in Tregs in cancer patients. Additional Treg inhibitors include agents that block trafficking of Tregs to the tumor microenvironment. Such agents may include antibodies against certain chemokines and chemokine receptors such as CCL17, CCL22 and CCR4.

Further examples of Treg-inhibitory agents that may be used in accordance with methods described herein are disclosed in the following patent applications, which are incorporated herein by reference in their entirety for all purposes: U.S. Patent Publication Nos. US 2009/0214533, US 2012/0142750, US 2011/0305713, US 2009/0004213, US 2012/0219559, US 2010/0278844, US 2013/0323283 and US 2008/0152665.

In another embodiment, an anti-GITR antibody or antigen-binding fragment thereof described herein can be administered to a subject before, during or after surgery.

In certain embodiments, an anti-GITR antibody or antigen-binding fragment thereof described herein is administered to a subject in combination with an immune modulator or antibody. Immune modulators or antibodies may be, but are not limited to, adjuvants, antigens, anti-CD3 (e.g., OKT3), checkpoint targeting agents or modulators, or interleukins. The terms "checkpoint targeting agent" or "checkpoint modulator" can be used interchangeably and refer to an agent that selectively modulates expression or activity of a regulatory molecule (e.g., a co-inhibitory checkpoint molecule (e.g., protein) or a costimulatory checkpoint molecule (e.g., protein), which may be, e.g., a receptor or a ligand) of an immune system checkpoint. Checkpoint targeting agents can be selected from the group consisting of an agonist of a checkpoint molecule, an antagonist of a checkpoint molecule, a polypeptide (e.g., a peptide ligand, an antibody, an antibody fragment) that selectively targets a checkpoint molecule; a small molecule that selectively targets a checkpoint molecule; and a regulatory nucleic acid (e.g., an siRNA, miRNA) that selectively modulates expression or activity of a checkpoint molecule. In one embodiment, a checkpoint targeting agent can be selected from the group consisting of an antagonist of PD-1, an antagonist of PD-L1, an antagonist of PD-L2, an antagonist of CTLA-4, an antagonist of TIM-3, an antagonist of LAG-3, an agonist of GITR, and an agonist of OX40. Thus, in some embodiments, an anti-GITR agonistic antibody (e.g., Hum231#1, Hum231#2 or Hum231#2w) or antigen-binding fragment thereof, may be administered in combination with, e.g., an anti-CTLA-4 antagonist antibody or antigen-binding fragment thereof, or another checkpoint targeting agent, either in a single pharmaceutical composition, or in separate pharmaceutical compositions administered together or separately.

In some embodiments, provided herein are methods for treating cancer in a subject comprising administering to the subject an anti-GITR antibody or antigen-binding fragment thereof and an agonist of OX40 and/or an antagonist(s) of LAG-3, TIM-3, PD-1 and/or CTLA-4. In some embodiments, the cancer is selected from glioblastoma multiforme, metastatic melanoma, resistant metastatic melanoma, metastatic ovarian cancer, metastatic renal cell carcinoma, head and neck cancer, gastric cancer, esophageal cancer, non-small cell lung cancer, pediatric brain tumors, low-grade asctrocytoma, ependymoma, and meduloblastoma.

In a specific embodiment, an anti-GITR antibody or antigen-binding fragment thereof described herein is administered to a subject in combination with an agent that inhibits (partially or completely) CTLA-4 signal transduction, such as an antibody that specifically binds to human CTLA-4 (e.g., tremelimumab (Pfizer); ipilimumab (Yervoy®, Bristol-Myers Squibb)) or a CTLA-4-Ig fusion protein. In some embodiments, an anti-GITR antibody or antigen-binding fragment thereof is used in combination with an antagonist of CTLA-4 (e.g., tremelimumab or ipilimumab) for the treatment of metastatic ovarian cancer. In some embodiments, an anti-GITR antibody or antigen-binding fragment thereof is used in combination with an antagonist of CTLA-4 (e.g., tremelimumab or ipilimumab) for the treatment of metastatic ovarian cancer that is resistant to an antagonist of CTLA-4 (e.g., tremelimumab or ipilimumab). In some embodiments, an anti-GITR antibody or antigen-binding fragment thereof and an antagonist of CTLA-4 (e.g., tremelimumab or ipilimumab) are used for the treatment of glioblastoma multiforme. In some embodiments, the glioblastoma multiforme is recurrent. In some embodiments, the glioblastoma multiforme is newly diagnosed. In some embodiments, the glioblastoma multiforme is in a subject having non-methylated MGMT promoters. In some embodiments, the glioblastoma multiforme is refractory to Bevacizumab therapy. In some embodiments, the glioblastoma multiforme is in a subject that has not received Bevacizumab therapy. Examples of anti-CTLA-4 antibodies that may be used in treatment methods disclosed herein are disclosed in the following patents and patent applications, which are incorporated herein by reference in their entirety for all purposes: International Publication Nos. WO 00/037504, WO 01/014424 and WO 09/100140; U.S. Pat. Nos. 6,207,156 and 7,034,121. Further examples of anti-CTLA-4 antibodies that may be used in accordance with the methods described herein are disclosed in the following patents and patent applications, which are incorporated herein by reference in their entirety for all purposes, U.S. Pat. Nos. 7,465,446, 8,263,073; 8,142,778 and 8,226,946; and U.S. Application Nos. US 2003/086930, US 2005/226875, US 2007/243184, US 2009/123477 and US 2011/044953.

In another embodiment, an anti-GITR antibody or antigen-binding fragment thereof described herein is administered in combination with an agent that inhibits (partially or completely) LAG-3 signal transduction, such as an antibody that specifically binds to human LAG-3. Examples of anti-LAG-3 antibodies or antibody fragments thereof that may be used in treatment methods described herein are disclosed in the following patents and patent applications, which are incorporated herein by reference in their entirety for all purposes: U.S. Pat. Nos. 6,143,273 and 6,197,524; U.S. Patent Publication Nos. US 2011/0150892, US 2010/0233183 and US 2010/196394.

In another embodiment, an anti-GITR antibody or antigen-binding fragment thereof described herein is administered in combination with an agent that inhibits (partially or completely) TIM-3 signal transduction, such as an antibody that specifically binds to human TIM-3. Examples of anti-TIM-3 antibodies or antibody fragments thereof that may be used in treatment methods described herein are disclosed in the following patents and patent applications, which are incorporated herein by reference in their entireties for all purposes: U.S. Pat. Nos. 7,470,428 and 8,101,176; U.S. Publication Nos. US 2013/0022623, US 2010/0100131, US 2010/0100131 and US 2010/061992.

In another embodiment, an anti-GITR antibody or antigen-binding fragment thereof described herein is administered in combination with an agent that inhibits (partially or completely) PD-1 signal transduction, such as an antibody that specifically binds to human PD-1. In some embodiments, an anti-PD-1 antibody or antibody fragment thereof is administered to a subject as described herein. In some embodiments, the anti-PD-1 antibody is Nivolumab (BMS-936558 or MDX1106) or Lambrolizumab (MK-3475) or Pidilizumab (CT-011). Further non-limiting examples of anti-PD-1 antibodies that may be used in treatment methods disclosed herein are disclosed in the following patents and patent applications, which are incorporated herein by reference in their entireties for all purposes: U.S. Pat. Nos. 6,808,710; 7,488,802; 8,008,449; 8,114,845 and 8,168,757, U.S. Publication No. US 2013/0202623 and PCT Publication No. WO 2013/033091.

In another embodiment, an anti-GITR antibody or antigen-binding fragment thereof described herein is administered in combination with an agent that inhibits (partially or completely) PD-L1 activity, such as an antibody that specifically binds to human PD-L1. In some embodiments, the anti-PD-L1 antibody is BMS-936559, MPDL3280A, MEDI4736 or MSB0010718C. Further non-limiting examples of anti-PD-L1 antibodies that may be used in treatment methods disclosed herein are disclosed in the following patents and patent applications, which are incorporated herein by reference in their entireties for all purposes: U.S. Pat. No. 8,168,179 and U.S. Publication Nos. US 2010/0203056 and US 2003/0232323. In another embodiment, an anti-GITR antibody or antigen-binding fragment thereof described herein is administered in combination with an agent that inhibits (partially or completely) PD-L2 activity, such as an antibody that specifically binds to human PD-L2.

In another embodiment, an anti-GITR antibody or antigen-binding fragment thereof described herein is administered in combination with an agent that activates or enhances OX-40 signal transduction, such as an antibody that specifically binds to human OX-40. Examples of anti-OX40 antibodies or antibody fragments thereof that may be used in treatment methods described herein are disclosed in the following patents and patent applications, which are incorporated herein by reference in their entireties for all purposes: U.S. Pat. Nos. 7,550,140; 7,807,156; 8,283,450; 8,614,295 and 7,531,170; U.S. Publication No. US 2010/0196359, US 2010/0136030 and US 2013/0183315.

In another embodiment, an anti-GITR antibody or antigen-binding fragment thereof described herein is administered to a subject in combination with a vaccine, such as described herein, including Section 5.4.1 above. In a specific embodiment, an anti-GITR antibody or antigen-binding fragment thereof is administered to a subject in combination with a heat shock protein based tumor-vaccine. Heat shock proteins (HSPs) are a family of highly conserved proteins found ubiquitously across all species. Their expression can be powerfully induced to much higher levels as a result of heat shock or other forms of stress, including exposure to toxins, oxidative stress or glucose deprivation. Five families have been classified according to molecular weight: HSP-110, -90, -70, -60 and -28. HSPs deliver immunogenic peptides through the cross-presentation pathway in antigen presenting cells (APCs) such as macrophages and dendritic cells (DCs), leading to T cell activation. HSPs function as chaperone carriers of tumor-associated antigenic peptides forming complexes able to induce tumor-specific immunity. Upon release from dying tumor cells, the HSP-antigen complexes are taken up by antigen-presenting cells (APCs) wherein the antigens are processed into peptides that bind MHC class I and class II molecules leading to the activation of anti-tumor CD8+ and CD4+ T cells. The immunity elicited by HSP complexes derived from tumor preparations is specifically directed against the unique antigenic peptide repertoire expressed by the cancer of each subject.

A heat shock protein peptide complex (HSPPC) is a protein peptide complex consisting of a heat shock protein non-covalently complexed with antigenic peptides. HSPPCs elicit both innate and adaptive immune responses. In a specific embodiment, the antigenic peptide(s) displays antigenicity for the cancer being treated. HSPPCs are efficiently seized by APCs via membrane receptors (mainly CD91) or by binding to Toll-like receptors. HSPPC internalization results in functional maturation of the APCs with chemokine and cytokine production leading to activation of natural killer cells (NK), monocytes and Th1 and Th-2-mediated immune responses. In some embodiments, HSPPCs used in methods disclosed herein comprise one or more heat shock proteins from the hsp60, hsp70, or hsp90 family of stress proteins complexed with antigenic peptides. In some embodiments, HSPPCs comprise hsc70, hsp70, hsp90, hsp110, grp170, gp96, calreticulin, or combinations of two or more thereof.

In a specific embodiment, an anti-GITR antibody or antigen-binding fragment thereof is administered to a subject in combination with a heat shock protein peptide complex (HSPPC), e.g., heat shock protein peptide complex-96 (HSPPC-96), to treat cancer, e.g., glioblastoma multiforme. HSPPC-96 comprises a 96 kDa heat shock protein (Hsp), gp96, complexed to antigenic peptides. HSPPC-96 is a cancer immunotherapy manufactured from a subject's tumor and contains the cancer's antigenic "fingerprint." In some embodiments, this fingerprint contains unique antigens that are present only in that particular subject's specific cancer cells and injection of the vaccine is intended to stimulate the subject's immune system to recognize and attack any cells with the specific cancer fingerprint.

In some embodiments, the HSPPC, e.g., HSPPC-96, is produced from the tumor tissue of a subject. In a specific embodiment, the HSPPC (e.g., HSPPC-96) is produced from tumor of the type of cancer or metastatis thereof being treated. In another specific embodiment, the HSPPC (e.g., HSPPC-96) is autologous to the subject being treated. In some embodiments, the tumor tissue is non-necrotic tumor tissue. In some embodiments, at least 1 gram (e.g., at least 1, at least 2, at least 3, at least 4, at least 5, at least 6, at least 7, at least 8, at least 9, or at least 10 grams) of non-necrotic tumor tissue is used to produce a vaccine regimen. In some embodiments, after surgical resection, non-necrotic tumor tissue is frozen prior to use in vaccine preparation. In some embodiments, the HSPPC, e.g., HSPPC-96, is isolated from the tumor tissue by purification techniques, filtered and prepared for an injectable vaccine. In some embodiments, a subject is administered 6-12 doses of the HSPPC, e.g., HSPCC-96. In such embodiments, the HSPPC, e.g., HSPPC-96, doses may be administered weekly for the first 4 doses and then biweekly for the 2-8 additional doses.

In some embodiments, an anti-GITR antibody or antigen-binding fragment thereof is used in combination with HSPPC-96 for the treatment of metastatic melanoma (e.g., resistant metastatic melanoma), metastatic ovarian cancer, or metastatic renal cell carcinoma. In some embodiments, an anti-GITR antibody or antigen-binding fragment thereof is used in combination with HSPPC-96 for the treatment of glioblastoma multiforme. In some embodiments, an anti-GITR antibody or antigen-binding fragment thereof and an antagonist of CTLA-4 are used in combination with HSPPC-96 for the treatment of glioblastoma multiforme. In some embodiments, the subject to be treated is immunosuppressed (e.g., due to infection, e.g., HIV, or by reason of having undergone anti-cancer therapy (e.g., chemotherapy radiation) prior to administration of the HSPPC.

Further examples of HSPPCs that may be used in accordance with the methods described herein are disclosed in the following patents and patent applications, which are incorporated herein by reference in their entireties for all purposes, U.S. Pat. Nos. 6,391,306, 6,383,492, 6,403,095, 6,410,026, 6,436,404, 6,447,780, 6,447,781 and 6,610,659.

In some embodiments, an anti-GITR antibody or antigen-binding fragment thereof described herein is administered to a subject in combination with a compound that targets an immunomodulatory enzyme(s) such as IDO (indoleamine-(2,3)-dioxygenase) and TDO (tryptophan 2,3-dioxygenase). In particular embodiments, such compound is selected from the group consisting of epacadostat (Incyte Corporation), F001287 (Flexus Biosciences), indoximod (NewLink Genetics), and NLG919 (NewLink Genetics). In one embodiment, the compound is epacadostat. In another embodiment, the compound is F001287. In another embodiment, the compound is indoximod. In another embodiment, the compound is NLG919.

Elevated numbers of $CD4^+CD25^+$ Tregs in cancer patients prevent the host from mounting an effective anti-tumor immune response. Additionally, high Treg frequencies are associated with reduced patient survival (Curiel T J et al., (2004) Nat Medicine 10(9): 942-9; Woo E Y et al., (2002) J Immunol 168: 4272-6). However, an enhancement of immune activity in cancer patients' PBMC was observed after depletion of regulatory T cells (Dannull J et al., (2005) J Clin Invest 115(12): 3623-33). Tregs expressing high levels of GITR on their surface can be depleted with anti-GITR antibody, DTA-1 (Coe D et al., (2010) Cancer Immunol Immunother 59: 1367-77). In one embodiment, an immune-based strategy may incorporate ex-vivo or in-vivo Treg depletion with an anti-GITR antibody or antigen-binding fragment thereof causing depletion of GITR-positive Treg cells.

In certain embodiments, an anti-GITR antibody or antigen-binding fragment thereof described herein is administered to a subject in combination with an oncolytic virus such as Talimogene laherparepvec (OncoVEX GM-CSF) and CGTG-102 (Ad5/3-D24-GMCSF).

In certain embodiments, an anti-GITR antibody or antigen-binding fragment thereof described herein is administered to a subject in combination with a cytokine(s) that is effective in inhibiting tumor growth/metastasis. Such cytokines, lymphokines, or other hematopoietic factors include, but are not limited to, M-CSF, GM-CSF, TNF, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IFN, TNFα, TNF1, TNF2, G-CSF, Meg-CSF, GM-CSF, thrombopoietin, stem cell factor, and erythropoietin.

In certain embodiments, an anti-GITR antibody or antigen-binding fragment thereof described herein is administered to a subject in combination with a receptor tyrosine kinase inhibitor(s) such as imatinib mesylate (marketed as Gleevec® or Glivac®), erlotinib (an EGF receptor inhibitor) now marketed as Tarveca, or sunitinib (marketed as Sutent®).

In certain embodiments, an anti-GITR antibody or antigen-binding fragment thereof described herein is administered to a subject in combination with an antagonistic TGF-beta antibody, such as Fresolimumab® (GC1008), an antibody targeting and inhibiting TGF-beta 1, 2 or 3 isoforms.

In some embodiments, an anti-GITR antibody or antigen-binding fragment thereof described herein or a composition thereof is administered to a subject suffering from or diagnosed with cancer. In a specific embodiment, an anti-GITR antibody or composition thereof is administered to a subject suffering from or diagnosed with a glioblastoma multiforme. In some embodiments, the glioblastoma multiforme is recurrent. In some embodiments, the glioblastoma multiforme is newly diagnosed. In some embodiments, the glioblastoma multiforme is in a subject having non-methylated MGMT promoters. In some embodiments, the glioblastoma multiforme is recurrent. In some embodiments, the glioblastoma multiforme is newly diagnosed. In some embodiments, the glioblastoma multiforme is in a subject having non-methylated MGMT promoters. In some embodiments, the glioblastoma multiforme is refractory to Bevacizumab therapy. In some embodiments, the glioblastoma multiforme is in a subject that has not received Bevacizumab therapy.

In certain embodiments, the patients being treated in accordance with the methods described herein are patients already being treated with antibiotics, anti-cancer agents, or other biological therapy/immunotherapy. Among these patients are refractory patients, patients who are too young for conventional therapies, and patients with reoccurring viral infections despite management or treatment with existing therapies.

In some embodiments, the subject being administered an anti-GITR antibody or antigen-binding fragment thereof described herein or a composition thereof has not received a therapy prior to the administration of the antibody or composition thereof. In other embodiments, an anti-GITR antibody or antigen-binding fragment thereof described herein or a composition thereof is administered to a subject who has received a therapy prior to administration of the antibody or composition thereof In certain embodiments, an anti-GITR antibody or antigen-binding fragment thereof, or composition thereof is administered to a subject receiving or recovering from immunosuppressive therapy. In certain embodiments, an anti-GITR antibody or composition thereof is administered to a subject with cancer and the cancer cells express GITRL. In some embodiments, the subject to be treated in accordance with the methods disclosed herein is immunosuppressed (e.g., due to infection, e.g., HIV, or by reason of having undergone anti-cancer therapy (e.g., chemotherapy radiation).

As described herein, anti-GITR antibodies affect the surface expression of proteins including OX40, CD25, and PD-1. Accordingly, in certain embodiments, an anti-GITR antibody or antigen-binding fragment thereof or composition thereof is administered prior to the administration of an antibody or antigen-binding fragment thereof that binds to OX40, CD25, or PD-1.

An antagonist PD-1 antibody or antigen-binding fragment thereof can be administered at a time at which the agonist GITR antibody or antigen-binding fragment thereof has increased surface expression of PD-1 in a subject relative to expression of PD-1 in the subject at the time of the administering. For example, an antagonist PD-1 antibody or antigen-binding fragment thereof can be administered at least 12 hours, at least 1 day, at least 2 days, at least 3 days, at least 4 days, at least 5 days, at least 6 days, or at least 7 days after administration of the agonist GITR antibody. An antagonist PD-1 antibody or antigen-binding fragment thereof can be administered from 12 hours to two weeks, from 1 day to two weeks, from 2 days to two weeks, or from 3 days to two weeks after administration of the agonist GITR antibody or antigen-binding fragment thereof. An antagonist PD-1 antibody or antigen-binding fragment thereof can be administered from 12 hours to one week, from 1 day to one week, from 2 days to one week, or from 3 days to one week after administration of the agonist GITR antibody or antigen-binding fragment thereof.

An agonist OX40 antibody or antigen-binding fragment thereof can be administered at a time at which the agonist GITR antibody or antigen-binding fragment thereof has increased surface expression of OX40 in a subject relative to expression of OX40 in the subject at the time of the administering. For example, an agonist OX40 antibody or antigen-binding fragment thereof can be administered at least 12 hours, at least 1 day, at least 2 days, at least 3 days, at least 4 days, at least 5 days, at least 6 days, or at least 7 days after administration of the agonist GITR antibody. An agonist OX40 antibody or antigen-binding fragment thereof can be administered from 12 hours to two weeks, from 1 day to two weeks, from 2 days to two weeks, or from 3 days to two weeks after administration of the agonist GITR antibody or antigen-binding fragment thereof. An agonist OX40 antibody or antigen-binding fragment thereof can be administered from 12 hours to one week, from 1 day to one week, from 2 days to one week, or from 3 days to one week after administration of the agonist GITR antibody or antigen-binding fragment thereof.

An anti-CD25 antibody or antigen-binding fragment thereof can be administered at a time at which the agonist GITR antibody or antigen-binding fragment thereof has increased surface expression of CD25 in a subject relative to expression of CD25 in the subject at the time of the administering. For example, an anti-CD25 antibody or antigen-binding fragment thereof can be administered at least 12 hours, at least 1 day, at least 2 days, at least 3 days, at least 4 days, at least 5 days, at least 6 days, or at least 7 days after administration of the agonist GITR antibody. An anti-CD25 antibody or antigen-binding fragment thereof can be administered from 12 hours to two weeks, from 1 day to two weeks, from 2 days to two weeks, or from 3 days to two weeks after administration of the agonist GITR antibody or antigen-binding fragment thereof. An anti-CD25 antibody or antigen-binding fragment thereof can be administered from 12 hours to one week, from 1 day to one week, from 2 days to one week, or from 3 days to one week after administration of the agonist GITR antibody or antigen-binding fragment thereof An antagonist CTLA-4 antibody or antigen-binding fragment thereof can be administered after administration of an agonist GITR antibody or antigen-binding fragment. For example, an antagonist CTLA-4 antibody or antigen-binding fragment thereof can be administered at least 12 hours, at least 1 day, at least 2 days, at least 3 days, at least 4 days, at least 5 days, at least 6 days, or at least 7 days after administration of the agonist GITR antibody. An antagonist CTLA-4 antibody or antigen-binding fragment thereof can be administered from 12 hours to two weeks, from 1 day to two weeks, from 2 days to two weeks, or from 3 days to two weeks after administration of the agonist GITR antibody or antigen-binding fragment thereof. An antagonist CTLA-4 antibody or antigen-binding fragment thereof can be administered from 12 hours to one week, from 1 day to one week, from 2 days to one week, or from 3 days to one week after administration of the agonist GITR antibody or antigen-binding fragment thereof.

Examples of cancer that can be treated in accordance with the methods described herein include, but are not limited to, B cell lymphomas (e.g., B cell chronic lymphocytic leukemia, B cell non-Hodgkin lymphoma, cutaneous B cell lymphoma, diffuse large B cell lymphoma), basal cell carcinoma, bladder cancer, blastoma, brain metastasis, breast cancer, Burkitt lymphoma, carcinoma (e.g., adenocarcinoma (e.g., of the gastroesophageal junction)), cervical cancer, colon cancer, colorectal cancer (colon cancer and rectal cancer), endometrial carcinoma, esophageal cancer, Ewing sarcoma, follicular lymphoma, gastric cancer, gastroesophageal junction carcinoma, gastrointestinal cancer, glioblastoma (e.g., glioblastoma multiforme, e.g., newly diagnosed or recurrent), glioma, head and neck cancer (e.g., head and neck squamous cell carcinoma), hepatic metastasis, Hodgkin's and non-Hodgkin's lymphoma, kidney cancer (e.g., renal cell carcinoma and Wilms' tumors), laryngeal cancer, leukemia (e.g., chronic myelocytic leukemia, hairy cell leukemia), liver cancer (e.g., hepatic carcinoma and hepatoma), lung cancer (e.g., non-small cell lung cancer and small-cell lung cancer), lymphblastic lymphoma, lymphoma, mantle cell lymphoma, metastatic brain tumor, metastatic cancer, myeloma (e.g., multiple myeloma), neuroblastoma, ocular melanoma, oropharyngeal cancer, osteosarcoma, ovarian cancer, pancreatic cancer (e.g., pancreatis ductal adenocarcinoma), prostate cancer (e.g., hormone refractory (e.g., castration resistant), metastatic, metastatic hormone refractory (e.g., castration resistant, androgen independent)), renal cell carcinoma (e.g., metastatic), salivary gland carcinoma, sarcoma (e.g., rhabdomyosarcoma), skin cancer (e.g., melanoma (e.g., metastatic melanoma)), soft tissue sarcoma, solid tumor, squamous cell carcinoma, synovia sarcoma, testicular cancer, thyroid cancer, transitional cell cancer (urothelial cell cancer), uveal melanoma (e.g., metastatic), verrucous carcinoma, vulval cancer, and Waldenstrom macroglobulinemia.

In some embodiments, the cancer treated in accordance with the methods described herein is a human sarcoma or carcinoma, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma (e.g., metastatic), hepatoma, bile duct carcinoma, choriocarcinoma, seminoma, embryonal carcinoma, Wilms' tumor, cervical cancer, testicular tumor, lung carcinoma, small cell lung carcinoma, bladder carcinoma, epithelial carcinoma, glioma, glioblastoma multiforme, astrocytoma, medulloblastoma, craniopharyngioma, ependymoma, pinealoma, hemangioblastoma, acoustic neuroma, oligodendroglioma, meningioma, melanoma, neuroblastoma, retinoblastoma. In certain embodiments, the cancer treated in accordance with the methods described herein is an acute lymphocytic leukemia or acute myelocytic leukemia (e.g., myeloblastic, promyelocytic, myelomonocytic, monocytic and erythroleukemia); chronic leukemia (chronic myelocytic (granulocytic) leukemia or chronic lymphocytic leukemia); Hodgkin's disease; non-Hodgkin's disease; acute myeloid leukemia; B-cell lymphoma; T-cell lymphoma; anaplastic large cell lymphoma; intraocular lymphoma; follicular lymphoma; small intestine lymphoma; orsplenic marginal zone lymphoma. In certain embodiments, the cancer treated in accordance with the methods described herein is multiple myeloma, Waldenstrom's macroglobulinemia, heavy chain disease, gastrointestinal stromal tumors, head and/or neck cancer (e.g., squamous cell carcinoma of the hypopharynx, squamous cell carcinoma of the larynx, cell carcinoma of the oropharynx, or verrucous carcinoma of the larynx), endometrial stromal sarcoma, mast cell sarcoma, adult soft tissue sarcoma, uterine sarcoma, merkel cell carcinoma, urothelial carcinoma, melanoma with brain metastases, uveal melanoma, uveal melanoma with liver metastases, non-small cell lung cancer, rectal cancer, or myelodysplastic syndrome, In some embodiments, the cancer treated in accordance with the methods is metastatic.

In certain embodiments, the cancer treated in accordance with the methods described herein includes prostate cancer, breast cancer, lung cancer, colorectal cancer, melanoma, bronchial cancer, bladder cancer, brain or central nervous system cancer, peripheral nervous system cancer, uterine or endometrial cancer, cancer of the oral cavity or pharynx, non-Hodgkin's lymphoma, thyroid cancer, kidney cancer, biliary tract cancer, small bowel or appendix cancer, salivary gland cancer, thyroid gland cancer, adrenal gland cancer, squamous cell cancer, mesothelioma, osteocarcinoma, thyoma/thymic carcinoma, glioblastoma, myelodysplastic syndrome, soft tissue sarcoma, DIPG, adenocarcinoma, osteosarcoma, chondrosarcoma, leukemia, or pancreatic cancer. In some embodiments, the cancer treated in accordance with the methods described herein includes a carcinoma (e.g., an adenocarcinoma), lymphoma, blastoma, melanoma, sarcoma or leukemia. In certain embodiments, the cancer treated in accordance with the methods described herein includes squamous cell cancer, small-cell lung cancer, non-small cell lung cancer, gastrointestinal cancer, Hodgkin's lymphoma, non-Hodgkin's lymphoma, pancreatic cancer, glioblastoma, glioma, cervical cancer, ovarian cancer, liver cancer (e.g., hepatic carcinoma and hepatoma), bladder cancer, breast cancer, inflammatory breast cancer, Merkel cell carcinoma, colon cancer, colorectal cancer, stomach cancer, urinary bladder cancer, endometrial carcinoma, myeloma (e.g., multiple myeloma), salivary gland carcinoma, kidney cancer (e.g., renal cell carcinoma and Wilms' tumors), basal cell carcinoma, melanoma, prostate cancer, vulval cancer, thyroid cancer, testicular cancer, esophageal cancer, serous adenocarcinoma or various types of head and neck cancer. In certain embodiments, the cancer treated in accordance with the methods described herein includes desmoplastic melanoma, inflammatory breast cancer, thymoma, rectal cancer, anal cancer, or surgically treatable or non-surgically treatable brain stem glioma. In a specific embodiment, the cancer is a solid tumor. In another specific embodiment, the cancer is glioblastoma multiforme. In some embodiments, the glioblastoma multiforme is recurrent. In some embodiments, the glioblastoma multiforme is newly diagnosed. In some embodiments, the glioblastoma multiforme is in a subject having non-methylated MGMT promoters. In some embodiments, the glioblastoma multiforme is refractory to Bevacizumab therapy. In some embodiments, the glioblastoma multiforme is in a subject that has not received Bevacizumab therapy.

In some embodiments, the cancer treated in accordance with the methods described herein is metastatic melanoma (e.g., resistant metastatic melanoma), metastatic ovarian cancer, or metastatic renal cell carcinoma. In certain embodiments, the cancer treated in accordance with the methods described herein is melanoma that is resistant to ipilimumab. In some embodiments, the cancer treated in accordance with the methods described herein is melanoma that is resistant to nivolumab. In some embodiments, the cancer treated in accordance with the methods described herein is melanoma that is resistant to ipilimumab and nivolumab.

5.4.1.2 Infectious Diseases

In a specific aspect, presented herein are methods for preventing and/or treating an infectious disease, comprising administering to a subject in need thereof an effective amount of an anti-GITR antibody or antigen-binding fragment thereof described herein or a composition thereof. In one embodiment, provided herein are methods for preventing and/or treating an infection (e.g., a viral infection, a bacterial infection, a fungal infection, a protozoal infection, or a parasitic infection). The infection prevented and/or treated in accordance with the methods can be caused by an infectious agent identified herein. In a specific embodiment, an anti-GITR antibody or antigen-binding fragment thereof described herein or a composition thereof is the only active agent administered to a subject. In some embodiments, an anti-GITR antibody or antigen-binding fragment thereof described herein or a composition thereof is used in combination with anti-infective interventions (e.g., antivirals, antibacterials, antifungals, or anti-helminthics) for the treatment of infectious diseases.

Infectious diseases that can be treated and/or prevented by an anti-GITR antibody or antigen-binding fragment thereof described herein are caused by infectious agents including but not limited to bacteria, parasites, fungi, protozae, and viruses. In a specific embodiment, the infectious disease treated and/or prevented by an anti-GITR antibody or antigen-binding fragment thereof described herein is caused by a virus. Viral diseases or viral infections that can be prevented and/or treated in accordance with the methods described herein include, but are not limited to, those caused by hepatitis type A, hepatitis type B, hepatitis type C, influenza (e.g., influenza A or influenza B), varicella, adenovirus, herpes simplex type I (HSV-I), herpes simplex type II (HSV-II), rinderpest, rhinovirus, echovirus, rotavirus, respiratory syncytial virus, papilloma virus, papova virus, cytomegalovirus, echinovirus, arbovirus, huntavirus, coxsackie virus, mumps virus, measles virus, rubella virus, polio virus, small pox, Epstein Barr virus, human immunodeficiency virus type I (HIV-I), human immunodeficiency virus type II (HIV-II), and agents of viral diseases such as viral meningitis, encephalitis, dengue or small pox.

Bacterial infections that can be prevented and/or treated include infections caused by *Escherichia coli, Klebsiella pneumoniae, Staphylococcus aureus, Enterococcus faecalis, Proteus vulgaris, Staphylococcus viridans*, and *Pseudomonas aeruginosa*. Bacterial diseases caused by bacteria (e.g., *Escherichia coli, Klebsiella pneumoniae, Staphylococcus aureus, Enterococcus faecalis, Proteus vulgaris, Staphylococcus viridans*, and *Pseudomonas aeruginosa*) that can be prevented and/or treated in accordance with the methods described herein include, but are not limited to, *Mycobacteria rickettsia, Mycoplasma, Neisseria, S. pneumonia, Borrelia burgdorferi* (Lyme disease), *Bacillus antracis* (anthrax), tetanus, Streptococcus, Staphylococcus, mycobacterium, pertussis, cholera, plague, diptheria, *chlamydia, S. aureus* and *legionella*.

Protozoal diseases or protozoal infections caused by protozoa that can be prevented and/or treated in accordance with the methods described herein include, but are not limited to, *leishmania*, coccidiosis, *trypanosoma schistosoma* or malaria. Parasitic diseases or parasitic infections caused by parasites that can be prevented and/or treated in accordance with the methods described herein include, but are not limited to, *chlamydia* and *rickettsia*.

Fungal diseases or fungal infections that can be prevented and/or treated in accordance with the methods described herein include, but are not limited to, those caused by

*Candida* infections, zygomycosis, *Candida mastitis*, progressive disseminated trichosporonosis with latent trichosporonemia, disseminated candidiasis, pulmonary paracoccidioidomycosis, pulmonary aspergillosis, *Pneumocystis carinii* pneumonia, cryptococcal meningitis, coccidioidal meningoencephalitis and cerebrospinal vasculitis, *Aspergillus niger* infection, *Fusarium keratitis*, paranasal sinus mycoses, *Aspergillus fumigatus* endocarditis, tibial dyschondroplasia, *Candida glabrata* vaginitis, oropharyngeal candidiasis, X-linked chronic granulomatous disease, tinea pedis, cutaneous candidiasis, mycotic placentitis, disseminated trichosporonosis, allergic bronchopulmonary aspergillosis, mycotic keratitis, *Cryptococcus neoformans* infection, fungal peritonitis, *Curvularia geniculata* infection, staphylococcal endophthalmitis, sporotrichosis, and dermatophytosis.

In certain embodiments, administering an anti-GITR antibody or antigen-binding fragment thereof described herein or a composition thereof to a subject (in some embodiments, an animal model) achieves one, two, three, four, or more of the following effects: (i) reduction or amelioration the severity of an infectious disease, an infection or symptom associated therewith; (ii) reduction in the duration of an infectious disease, an infection or symptom associated therewith; (iii) inhibition of the progression of an infectious disease, an infection or symptom associated therewith; (iv) regression of an infectious disease, an infection or symptom associated therewith; (v) inhibition of the development or onset of an infectious disease, an infection or symptom associated therewith; (vi) inhibition of the recurrence of an infectious disease or symptom associated therewith; (vii) reduction or inhibition of the spread of an infectious agent from one cell to another cell, one tissue to another tissue, or one organ to another organ; (viii) inhibition or reduction of the spread/transmission of an infectious agent from one subject to another subject; (ix) reduction in organ failure associated with an infectious disease; (x) reduction in the hospitalization of a subject; (xi) reduction in the hospitalization length; (xii) an increase in the survival of a subject with an infectious disease or an infection; (xiii) elimination of an infectious disease or an infection; (xiii) inhibition or reduction in replication of an infectious agent or an infection; (xiv) inhibition or reduction in the entry of an infectious agent into a cell(s); (xv) inhibition or reduction of replication of the genome of an infectious agent; (xvi) inhibition or reduction in the synthesis of infectious agent proteins; (xvii) inhibition or reduction in the assembly of infectious agents; (xviii) inhibition or reduction in the release of infectious agents from a cell(s); (xviii) reduction in the number or titer of an infectious agent; (xix) the reduction in the number of symptoms associated with an infectious disease or an infection; (xx) enhancement, improvement, supplementation, complementation, or augmentation of the prophylactic or therapeutic effect(s) of another therapy; and/or (xxi) prevention of the onset or progression of a secondary infection associated with an infectious disease.

In certain embodiments, two or more different anti-GITR antibodies or antigen-binding fragments thereof described herein are administered to a subject. In some embodiments, an anti-GITR antibody or antigen-binding fragment thereof described herein is administered to a subject in combination with one or more other therapies. In one embodiment, an anti-GITR antibody or antigen-binding fragment thereof described herein is administered in combination with one or more anti-fungals.

In a specific embodiment, an anti-GITR antibody or antigen-binding fragment thereof described herein is administered to a subject in combination with one or more antibiotics. Examples of antibiotics, that can be used in combination with an anti-GITR antibody or antigen-binding fragment thereof described herein include aminoglycoside antibiotics, glycopeptides, amphenicol antibiotics, ansamycin antibiotics, cephalosporins, cephamycins oxazolidinones, penicillins, quinolones, streptogamins, tetracyclins, and analogs thereof In another embodiment, an anti-GITR antibody or antigen-binding fragment thereof described herein is administered in combination with one or more anti-virals. Examples of antiviral agents that can be used in combination with an anti-GITR antibody or antigen-binding fragment thereof described herein include non-nucleoside reverse transcriptase inhibitors, nucleoside reverse transcriptase inhibitors, protease inhibitors and fusion inhibitors. In one embodiment, the antiviral agent is amantadine, oseltamivir phosphate, rimantadine, and zanamivir. In another embodiment, the antiviral agent is a non-nucleoside reverse transcriptase inhibitor such as delavirdine, efavirenz or nevirapine. In another embodiment, the antiviral agent is a nucleoside reverse transcriptase inhibitor such as abacavir, didanosine, emtricitabine, emtricitabine, lamivudine, stavudine, tenofovir DF, zalcitabine or zidovudine. In another embodiment, the antiviral agent is a protease inhibitor such as amprenavir, atazanavir, fosamprenav, indinavir, lopinavir, nelfinavir, ritonavir or saquinavir. In another embodiment, the antiviral agent is a fusion inhibitor such as enfuvirtide. In another embodiment, the antiviral agent is oseltamivir phosphate, amphotericin B or palivizumab.

In a specific embodiment, an anti-GITR antibody or antigen-binding fragment thereof is administered to a subject in combination with a vaccine that is a heat shock protein preparation comprising a heat shock protein complexed to antigenic peptides comprising an antigen from a pathogen (e.g., a virus, bacteria, fungus, etc.). In some embodiments, an anti-GITR antibody or antigen-binding fragment thereof is administered to a subject in combination with a vaccine that is a heat shock protein preparation comprising heat shock proteins complexed with antigenic peptides comprising viral antigens (e.g., antigens of HSV-1 or HSV-2). In some embodiments, the heat shock protein preparation comprising heat shock proteins complexed with antigenic peptides comprising viral antigens (e.g., antigens of HSV-1 or HSV-2) is combined with an adjuvant, such as QS-21. In some embodiments, the vaccine is HerpV (Agenus Inc.), which is a vaccine for the treatment of herpes infections. A non-limiting example of a suitable vaccine is disclosed in Mo A., et al., (2011), Vaccine 29: 8530-8541, the contents of which are incorporated herein by reference in their entirety. Further non-limiting examples are disclosed in U.S. Pat. No. 8,541,002, the contents of which are incorporated herein by reference in their entirety.

In some embodiments, an anti-GITR antibody or antigen-binding fragment thereof described herein, or composition thereof is administered to a subject suffering from an infectious disease caused by infectious agents including, but not limited to bacteria, fungi, protozae and viruses. In certain embodiments, an anti-GITR antibody or antigen-binding fragment thereof described herein, or composition thereof is administered to a subject diagnosed as having an infectious disease caused by infectious agents including, but not limited to bacteria, fungi, protozae and viruses. In some embodiments, an anti-GITR antibody or antigen-binding fragment thereof described herein, or a composition thereof is administered to a subject with an infection. In some embodiments, the subject treated in accordance with the method described herein is immunocompromised or immunosuppressed. In certain embodiments, the subject treated in accordance with methods described herein has, is, or otherwise will receive another therapy (e.g., an anti-viral agent, antibiotic, or anti-fungal agent).

5.4.1.3 Routes of Administration & Dosage

An antibody or an antigen-binding fragment thereof, or composition described herein may be delivered to a subject by a variety of routes. These include, but are not limited to, parenteral, intranasal, intratracheal, oral, intradermal, topical, intramuscular, intraperitoneal, transdermal, intravenous, intratumoral, conjunctival and subcutaneous routes. Pulmonary administration can also be employed, e.g., by use of an inhaler or nebulizer, and formulation with an aerosolizing agent for use as a spray.

The amount of an antibody or an antigen-binding fragment thereof, or composition which will be effective in the treatment and/or prevention of a condition will depend on the nature of the disease, and can be determined by standard clinical techniques.

The precise dose to be employed in a composition will also depend on the route of administration, and the seriousness of the infection or disease caused by it, and should be decided according to the judgment of the practitioner and each subject's circumstances. For example, effective doses may also vary depending upon means of administration, target site, physiological state of the patient (including age, body weight and health), whether the patient is human or an animal, other medications administered, or whether treatment is prophylactic or therapeutic. Usually, the patient is a human but non-human mammals including transgenic mammals can also be treated. Treatment dosages are optimally titrated to optimize safety and efficacy.

In certain embodiments, an in vitro assay is employed to help identify optimal dosage ranges. Effective doses may be extrapolated from dose response curves derived from in vitro or animal model test systems.

For passive immunization with an antibody (or an antigen-binding fragment thereof), the dosage ranges from about 0.0001 to 100 mg/kg, and more usually 0.01 to 15 mg/kg, of the patient body weight. For example, dosages can be 1 mg/kg body weight, 10 mg/kg body weight, or within the range of 1-10 mg/kg or in other words, 70 mg or 700 mg or within the range of 70-700 mg, respectively, for a 70 kg patient. In some embodiments, the dosage administered to the patient is about 1 mg/kg to about 20 mg/kg of the patient's body weight. Generally, human antibodies have a longer half-life within the human body than antibodies from other species due to the immune response to the foreign polypeptides. Thus, lower dosages of human antibodies and less frequent administration is often possible.

An exemplary treatment regime entails administration once per every two weeks or once a month or once every 3 to 6 months for a period of one year or over several years, or over several year-intervals. In some methods, two or more antibodies or antigen-binding fragments thereof with different binding specificities are administered simultaneously to a subject. An antibody or antigen-binding fragment thereof is usually administered on multiple occasions. Intervals between single dosages can be weekly, monthly, every 3 months, every 6 months or yearly.

5.4.2 Detection & Diagnostic Uses

An anti-GITR antibody or an antigen-binding fragment thereof described herein (see, e.g., Section 5.1) can be used to assay GITR protein levels in a biological sample using classical immunohistological methods known to those of skill in the art, including immunoassays, such as the enzyme linked immunosorbent assay (ELISA), immunoprecipitation, or Western blotting. Suitable antibody assay labels are known in the art and include enzyme labels, such as, glucose oxidase; radioisotopes, such as iodine ($^{125}$I, $^{121}$I), carbon ($^{14}$C), sulfur ($^{35}$S), tritium ($^{3}$H), indium ($^{121}$In), and technetium ($^{99}$Tc); luminescent labels, such as luminol; and fluorescent labels, such as fluorescein and rhodamine, and biotin. Such labels can be used to label an antibody or an antigen-binding fragment thereof described herein. Alternatively, a second antibody that recognizes an anti-GITR antibody or antigen-binding fragment thereof described herein can be labeled and used in combination with an anti-GITR antibody or antigen-binding fragment thereof to detect GITR protein levels.

Assaying for the expression level of GITR protein is intended to include qualitatively or quantitatively measuring or estimating the level of a GITR protein in a first biological sample either directly (e.g., by determining or estimating absolute protein level) or relatively (e.g., by comparing to the disease associated protein level in a second biological sample). GITR polypeptide expression level in the first biological sample can be measured or estimated and compared to a standard GITR protein level, the standard being taken from a second biological sample obtained from an individual not having the disorder or being determined by averaging levels from a population of individuals not having the disorder. As will be appreciated in the art, once the "standard" GITR polypeptide level is known, it can be used repeatedly as a standard for comparison.

As used herein, the term "biological sample" refers to any biological sample obtained from a subject, cell line, tissue, or other source of cells potentially expressing GITR. Methods for obtaining tissue biopsies and body fluids from animals (e.g., humans) are well known in the art. Biological samples include peripheral mononuclear blood cells.

An anti-GITR antibody or antigen-binding fragment thereof described herein can be used for prognostic, diagnostic, monitoring and screening applications, including in vitro and in vivo applications well known and standard to the skilled artisan and based on the present description. Prognostic, diagnostic, monitoring and screening assays and kits for in vitro assessment and evaluation of immune system status and/or immune response may be utilized to predict, diagnose and monitor to evaluate patient samples including those known to have or suspected of having an immune system-dysfunction or with regard to an anticipated or desired immune system response, antigen response or vaccine response. The assessment and evaluation of immune system status and/or immune response is also useful in determining the suitability of a patient for a clinical trial of a drug or for the administration of a particular chemotherapeutic agent or an antibody or antigen-binding fragment thereof, including combinations thereof, versus a different agent or antibody or antigen-binding fragment thereof. This type of prognostic and diagnostic monitoring and assessment is already in practice utilizing antibodies against the HER2 protein in breast cancer (HercepTest™, Dako) where the assay is also used to evaluate patients for antibody therapy using Herceptin®. In vivo applications include directed cell therapy and immune system modulation and radio imaging of immune responses.

In one embodiment, an anti-GITR antibody or antigen-binding fragment thereof can be used in immunohistochemistry of biopsy samples.

In another embodiment, an anti-GITR antibody or antigen-binding fragment thereof can be used to detect levels of GITR, or levels of cells which contain GITR on their membrane surface, which levels can then be linked to certain disease symptoms. Anti-GITR antibodies or antigen-binding fragments thereof described herein may carry a detectable or functional label. When fluorescence labels are used, currently available microscopy and fluorescence-activated cell sorter analysis (FACS) or combination of both methods procedures known in the art may be utilized to identify and to quantitate the specific binding members. Anti-GITR antibodies or antigen-binding fragments thereof described herein may carry a fluorescence label. Exemplary fluorescence labels include, for example, reactive and conjugated probes e.g. Aminocoumarin, Fluorescein and Texas red, Alexa Fluor dyes, Cy dyes and DyLight dyes. An anti-GITR antibody or antigen-binding fragment thereof may carry a radioactive label, such as the isotopes $^{3}$H, $^{14}$C, $^{32}$P, $^{35}$S, $^{36}$Cl, $^{51}$Cr, $^{57}$Co, $^{58}$Co, $^{59}$Fe, $^{67}$Cu, $^{90}$Y, $^{99}$Tc, $^{111}$In, $^{117}$Lu, $^{121}$I, $^{124}$I, $^{125}$I, $^{131}$I, $^{198}$Au, $^{211}$At, $^{213}$Bi, $^{225}$Ac and $^{186}$Re. When radioactive labels are used, currently available counting procedures known in the art may be utilized to identify and quantitate the specific binding of anti-GITR antibody or antigen-binding fragment thereof to GITR (e.g., human GITR). In the instance where the label is an enzyme, detection may be accomplished by any of the presently utilized colorimetric, spectrophotometric, fluorospectrophotometric, amperometric or gasometric techniques as known in the art. This can be achieved by contacting a sample or a control sample with an anti-GITR antibody or antigen-binding fragment thereof under conditions that allow for the formation of a complex between the antibody or antigen-binding fragment thereof and GITR. Any complexes formed between the antibody or antigen-binding fragment thereof and GITR are detected and compared in the sample and the control. In light of the specific binding of the antibodies described herein for GITR, the antibodies or antigen-binding fragments thereof can be used to specifically detect GITR expression on the surface of cells. The antibodies or antigen-binding fragments thereof described herein can also be used to purify GITR via immunoaffinity purification.

Also included herein is an assay system which may be prepared in the form of a test kit for the quantitative analysis of the extent of the presence of, for instance, GITR or GITR/GITRL complexes. The system or test kit may comprise a labeled component, e.g., a labeled antibody, and one or more additional immunochemical reagents. See, e.g., Section 5.5 below for more on kits.

5.5 Kits

Provided herein are kits comprising one or more antibodies described herein, or antigen-binding fragments thereof, or conjugates thereof. In a specific embodiment, provided herein is a pharmaceutical pack or kit comprising one or more containers filled with one or more of the ingredients of the pharmaceutical compositions described herein, such as one or more antibodies provided herein or an antigen-binding fragment thereof. In some embodiments, the kits contain a pharmaceutical composition described herein and any prophylactic or therapeutic agent, such as those described herein. In certain embodiments, the kits may contain a T cell mitogen, such as, e.g., phytohaemagglutinin (PHA) and/or phorbol myristate acetate (PMA), or a TCR complex stimulating antibody, such as an anti-CD3 antibody and anti-CD28 antibody. Optionally associated with such container(s) can be a notice in the form prescribed by a governmental agency regulating the manufacture, use or sale of pharmaceuticals or biological products, which notice reflects approval by the agency of manufacture, use or sale for human administration.

Also provided herein are kits that can be used in the above methods. In one embodiment, a kit comprises an antibody described herein, preferably a purified antibody, in one or more containers. In a specific embodiment, kits described herein contain a substantially isolated GITR antigen (e.g., human GITR) as a control. In another specific embodiment, the kits described herein further comprise a control antibody which does not react with a GITR antigen. In another specific embodiment, kits described herein contain one or more elements for detecting the binding of an antibody to a GITR antigen (e.g., the antibody can be conjugated to a detectable substrate such as a fluorescent compound, an enzymatic substrate, a radioactive compound or a luminescent compound, or a second antibody which recognizes the first antibody can be conjugated to a detectable substrate). In specific embodiments, a kit provided herein can include a recombinantly produced or chemically synthesized GITR antigen. The GITR antigen provided in the kit can also be attached to a solid support. In a more specific embodiment, the detecting means of the above described kit includes a solid support to which a GITR antigen is attached. Such a kit can also include a non-attached reporter-labeled anti-human antibody or anti-mouse/rat antibody. In this embodiment, binding of the antibody to the GITR antigen can be detected by binding of the said reporter-labeled antibody.

The following examples are offered by way of illustration and not by way of limitation.

6. EXAMPLES

The examples in this Section (i.e., Section 6) are offered by way of illustration, and not by way of limitation.

6.1 Example 1: Generation of Novel Antibodies Against Human GITR

This example describes the generation and characterization of murine antibodies that bind to human GITR. In particular, this example describes the generation of murine antibodies that specifically bind to human GITR and exhibit a co-stimulatory effect on CD4$^+$ T cells.

To generate novel GITR antibodies, mouse CMS5a cells transfected with human GITR were used as immunogen in combination with an adjuvant (monophosphoryl lipid A (MPL), trehalose dimyocloate (TDM), muramyl dipeptide (MDP) and freund's adjuvant (FA)) in BALB/c mice. Spleen cells from immunized mice were fused with mouse myeloma cell line SP2/0. Supernatants of newly generated clones were screened in mixed hemadsorption assays on hGITR-transfected CMS5a and wild type CMS5a cells. Selected supernatants were further tested by ELISA on recombinant hGITR protein (HGITR-Fc, Sigma). Fusion #231 resulted in four hybridomas (231-32-15, 231-1039-45, 231-1042-7 and 231-1333-21) with selective reactivity for human GITR (sometimes referred to herein hGITR or huGITR) by MHA and ELISA. The antibodies (all IgG$_1$) were purified by protein G affinity chromatography for further testing.

The specificity of the anti-GITR-antibodies was tested by Western blot against purified recombinant human GITR, recombinant mouse GITR, CMS5a cells transfected with human GITR, wild-type CMS5a cells, activated CD4$^+$ T cells and untreated CD4$^+$ T cells. The Western blot, under non-reducing conditions, is depicted in FIG. 1. The anti-GITR antibodies were reactive with purified recombinant human GITR, not reactive with recombinant mouse GITR, reactive with recombinant human GITR in CMS5a cells, and reactive with natural human GITR in activated CD4+ T cells.

Analysis of ligand (GITR-L) and monoclonal antibody binding to immobilized huGITR was performed by surface plasmon resonance and measured on BIAcore®. GITR (~1100 RU) was immobilized onto a CM5 sensor chip using standard amine coupling. Analytes were injected over the immobilized GITR for 15 minutes at a flow rate of 5 µl/min followed by a 10 minute dissociation period. After kinetic runs had been performed the affinity and dissociation constants were simultaneously calculated by BiaEvaluation® software (Biacore Life Sciences). Binding of human GITR-L was analysed over a concentration range of 12.5-200 nM and murine anti-GITR monoclonal antibodies were analysed over a concentration of 6.25-100 nM. The antibodies did not bind to immobilized mouse GITR. Affinity and dissociation constants for the antibodies are tabulated below in Table 9.

TABLE 9

| Analyte | $K_A$ (1/M) | $K_D$ (M) |
|---|---|---|
| huGITR-L | $1.81 \times 10^8$ | $5.54 \times 10^{-9}$ |
| mAb 231-1039-45 | $4.20 \times 10^8$ | $2.38 \times 10^{-9}$ |
| mAb 231-32-15 | $4.04 \times 10^8$ | $2.47 \times 10^{-9}$ |
| mAb 231-1333-21 | $4.19 \times 10^8$ | $2.39 \times 10^{-9}$ |
| mAb 231-1042-07 | $4.30 \times 10^8$ | $2.33 \times 10^{-9}$ |

Hybridomas 231-32-15, 231-1039-45, 231-1042-7 and 231-1333-21 were sequenced and found to have the same c and protein sequences. The protein sequences of the VH and VL were confirmed by N-terminal protein sequencing and mass spectrometry (MS) of tryptic digests. The variable heavy chain sequence of the anti-GITR antibodies is SEQ ID NO: 201 and the variable light chain sequence of the anti-GITR antibodies is SEQ ID NO: 202. The heavy chain variable region (VH) complementarity determining region (CDR) sequences VH CDR1, VH CDR2 and VH CDR3 have SEQ ID NOS: 13, 14 and 15, respectively and the light chain variable region (VL) CDR sequences VL CDR1, VL CDR2 and VL CDR3 have SEQ ID NOS: 16, 17 and 18, respectively.

Figure 2A:
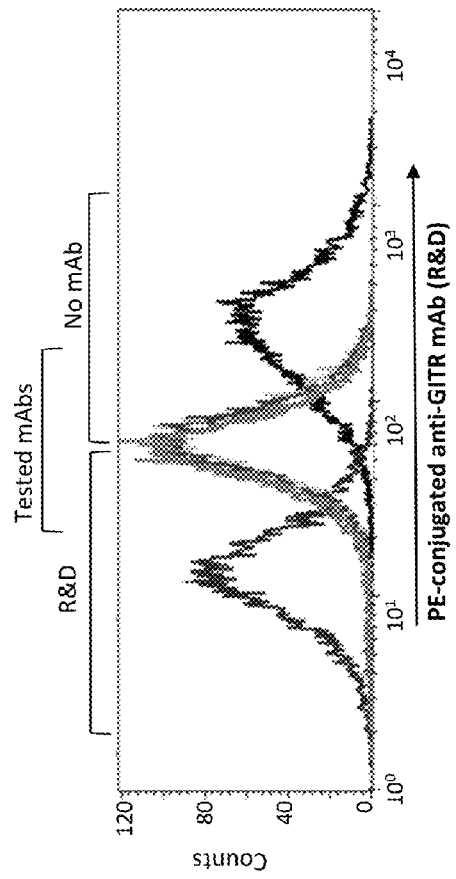
Figure 2B:
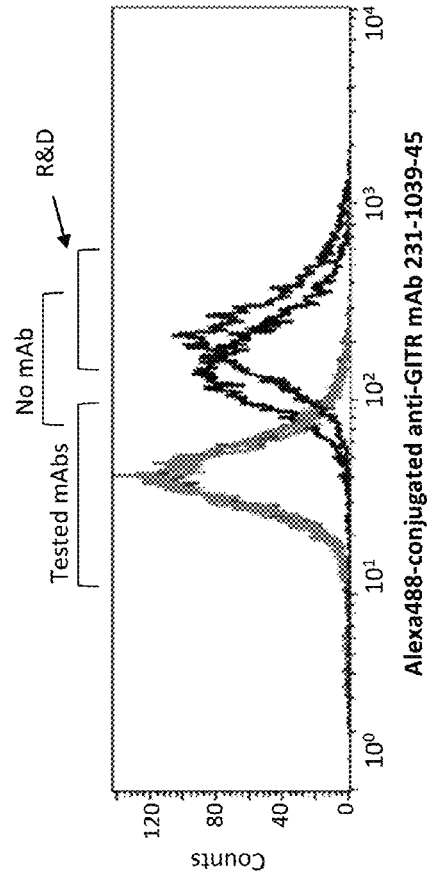

Competitive binding of the new 231-GITR antibodies was compared to a commercially available anti-GITR monoclonal antibody (R&D Systems mAb689 clone 110416). GITR transfected CMS5a cells were used and incubated with an unlabeled anti-GITR mAb, followed by addition of PE-conjugated R&D mAb or Alexa 488-conjugated 231-1039-45 or 213-1333-21 antibody (data not shown for Alexa 448-conjugated 213-1333-21 antibody), with results assessed by FACS analysis. Blocking studies of the R&D systems anti-GITR mAb are depicted in FIG. 2A and blocking studies of a 231 antibody (1039-45) are depicted in FIG. 2B. In these studies, either no antibody, unlabeled R&D antibody or unlabeled test antibodies (antibodies 1042-7, 1039-45, 1331-21 or 32-15) were first added and incubated with M5Sa-GITR transfected cells. This was then followed by addition of labeled R&D systems antibody (FIG. 2A) or the labeled 231-anti-GITR antibody 1039-45 (FIG. 2B). The new 231 antibodies (1042-7, 1039-45, 1333-21 or 32-15) only partially blocked the binding of the R&D antibody, possibly due to steric hindrance (FIG. 2A). FIG. 2B shows that the R&D antibody did not block the binding of the 231-1039-45 antibody. Binding of 1039-45 was inhibited by any of the 231 antibodies (i.e., by 1042-7, 1039-45, 1333-21 or 32-15).

Figure 3A:
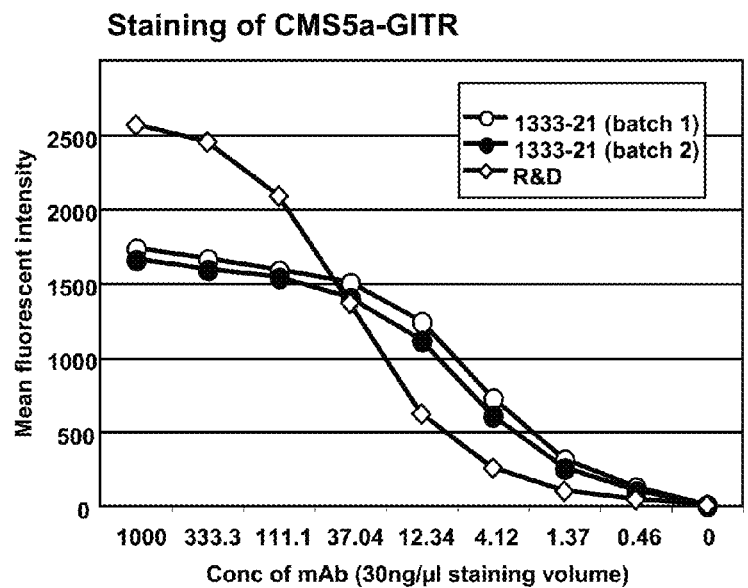
Figure 3B:
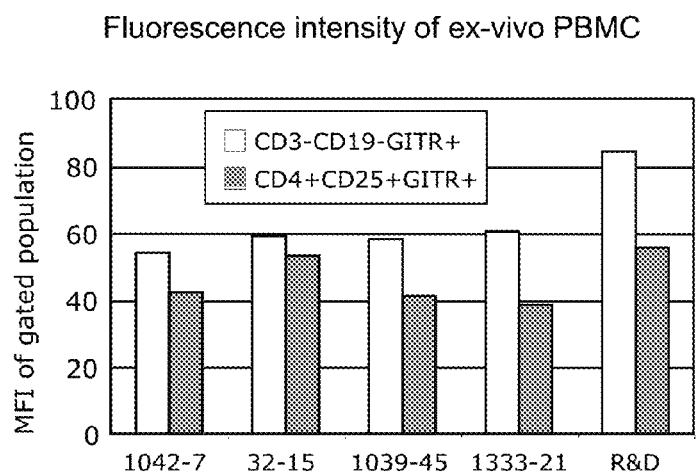
Figure 3C:
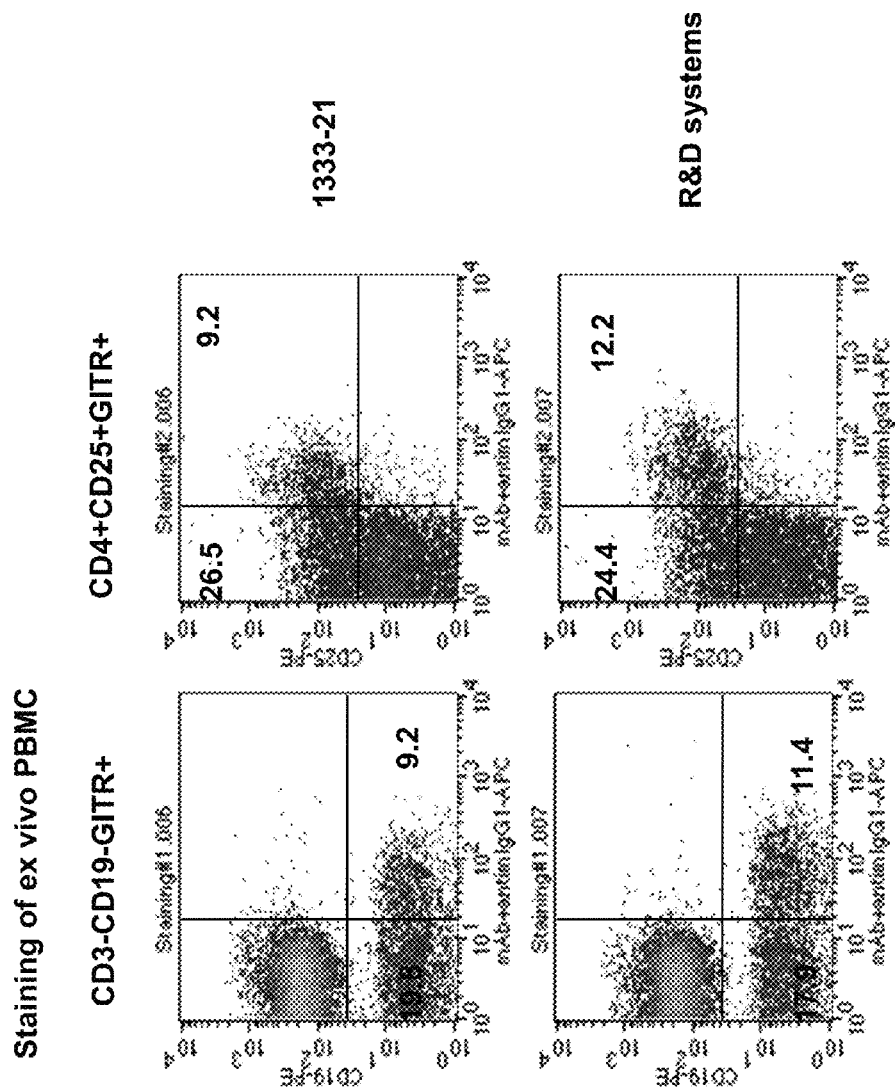

The binding characteristics of the 231-GITR antibodies were analyzed by FACS and the results are depicted in FIGS. 3A-C. FIG. 3A shows staining of CMS5a-GITR cells with anti-human GITR IgG$_1$ 1333-21 antibody from two different batches (1 and 2) and R&D Systems antibody. In FIG. 3B, fluorescence intensity of ex-vivo PMBC derived CD3$^-$ CD19$^-$ GITR$^+$ and CD4$^+$CD25$^+$ GITR$^+$ is shown upon staining with 1042-7, 32-15, 1039-45, 1333-21 and R&D Systems antibodies. FACS analysis of these in vivo PBMC derived cells after 1333-21 or R&D systems antibody (mAb689 clone 110416) binding is shown in FIG. 3C.

Figure 4:
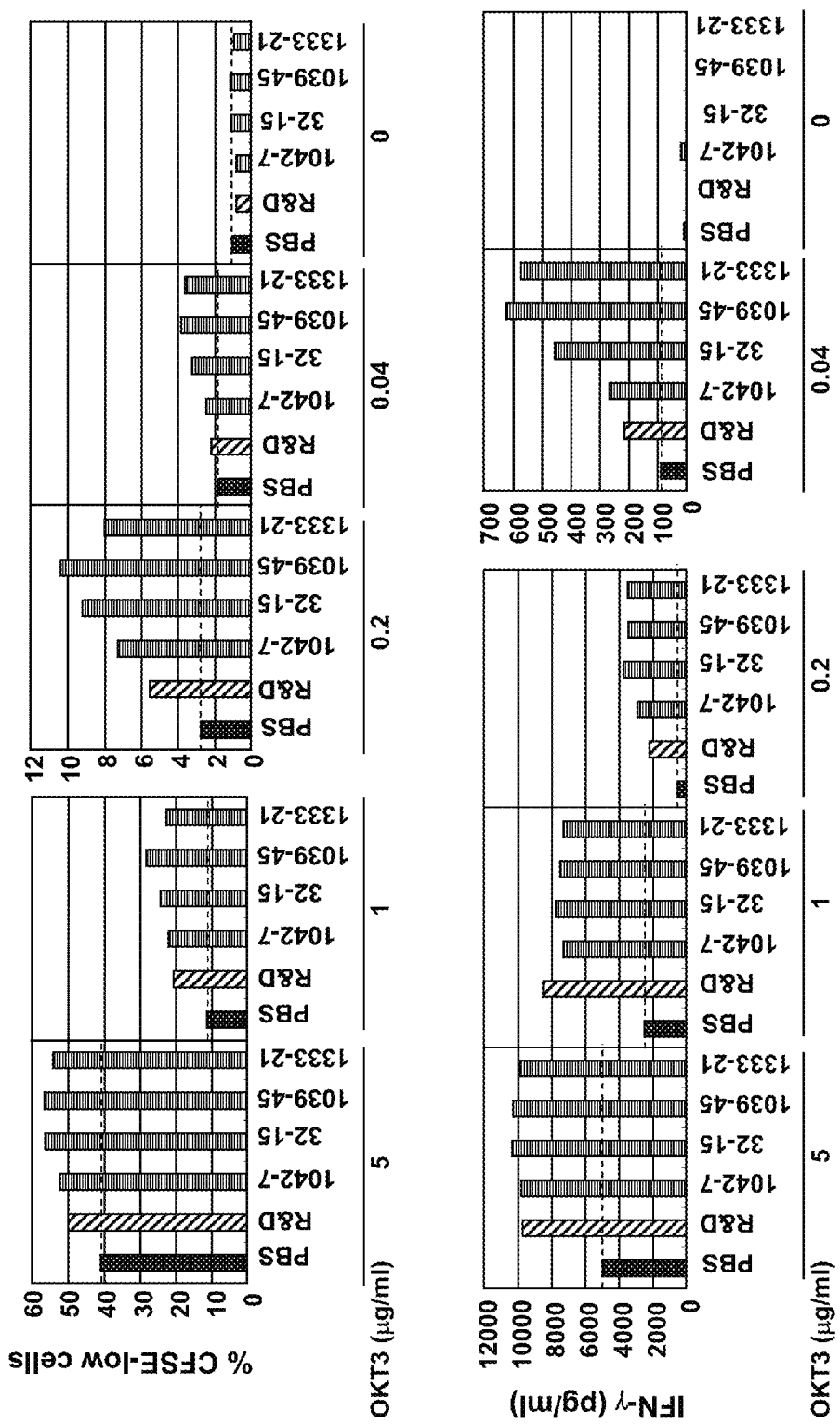

Next, studies were performed to assess the costimulatory effect of the anti-GITR antibody on CD4$^+$ T cells in combination with anti-CD3 (OKT3) antibody. The most significant relative costimulatory effect was observed by combining anti-GITR antibodies (231-1042-7, 231-32-15, 231-1039-45, 231-1333-21) with a suboptimal concentration (0.2 µg/ml) of OKT3. Anti-GITR antibody (5 µg/ml) and OKT-3 antibody at varying concentrations were bound to tissue culture plates and then incubated with CSFE-labeled CD4$^+$ cells. IL-2 (10 U/ml) was added to the medium and the cells and antibodies were incubated a further 5 days. At the end of 5 days, CFSE intensity was evaluated with divided cells having low CFSE intensity. IFNγ was also measured. The results for the anti-GITR antibodies are depicted in FIG. 4. At a suboptimal concentration of OKT3 antibody (0.2 µg/ml), the anti-GITR antibodies had a significant relative effect on proliferation of CD4$^+$ cells. An increase in IFNγ compared to controls was seen in the presence of the anti-GITR antibody combined with all levels of OKT3 tested, with the most pronounced effect observed at 0.2 µg/ml and 0.04 µg/ml. Variation between the antibodies tested can be attributable to intra-assay variability and a natural variability between each antibody preparation (e.g. separate preparation). Notably, in the absence of OKT3, there is no stimulation by the anti-GITR antibodies. The costimulatory effect of the anti-GITR antibodies with OKT3 was dose dependent on the amount of the anti-GITR antibodies (data not shown).

In conclusion, new anti-GITR antibodies have been isolated that are specific for human GITR and recognize recombinant and natural GITR. These antibodies bind hGITR expressed on hGITR-transfected CMS5a cells at 2.5-5 ng/ml and show good binding by FACS analysis. The antibodies also bound to human PBMC including T cells expressing natural hGITR. Their affinity for GITR by BIAcore® is $K_A$ (1/m) approximately $4.2 \times 10^8$, $K_D$ (m) $2.4 \times 10^{-9}$ (versus GITRL (ligand) $K_A$ of $1.8 \times 10^8$ and $K_D$ $5.5 \times 10^{-9}$). The antibodies bind to a different site on hGITR versus a commercially available GITR mAb (R&D).

A costimulatory effect of anti-GITR monoclonal antibody with suboptimal concentrations (0.2 µg/ml and 0.04 µg/ml) of anti-CD3 mAb (OKT3) on CD4$^+$ T cells has been demonstrated. Despite the presence of T-regulatory cells in the population of enriched CD4$^+$ T cells, the anti-GITR antibodies enhanced CD4$^+$ T cell activity.

6.2 Example 2: Humanization of Mouse Monoclonal Antibody 231-32-15

This example describes the humanization of the murine antibody 231-32-15 and the characterization of the humanized antibodies.

6.2.1 Humanization of murine antibody 231-32-15

Humanization of the anti-human GITR mouse antibody 231-32-15 including selection of human acceptor frameworks is described herein.

6.2.2 Chimerization of murine antibody 231-32-15

The murine VH and VL (kappa) variable regions from murine 231-32-15 having SEQ ID NOS: 201 and 202, respectively, were synthesized by GeneArt® (Life Technologies™). The natural leader sequences from the original murine variable domains were included along with adapters with restriction sites to allow the cloning of these variable regions directly into standard in-house human IgG$_1$ Vh vector (CH1-2-3 domains), and Vk vector (Ckl), to create chimeric genes with a murine Vh or Vk, and human constant regions. The chimeric heavy and light chain expression vectors were then co-transfected into CHO cells in suspension to produce chimeric antibody protein for use in the assays performed below. This chimeric antibody is referred to in the Examples in Section 6 as the "chimeric parental 231-32-15 antibody". This chimeric parental 231-32-15 antibody contains a T109S substitution (i.e., substitution of threonine with serine at position 109 relative to the wild type Fc sequence), numbered according to Kabat, in the light chain constant domain, which facilitates the cloning of the variable region in frame to the constant region. This mutation is a conservative modification that does not affect antibody binding or function.

Homology matching was used to choose human acceptor frameworks to graft the CDRs of antibody 231-32-15. Databases, e.g., a database of germline variable genes from the immunoglobulin loci of human and mouse (the IMGT database (the international ImMunoGeneTics information system®; Lefranc M P et al., (1999) Nucleic Acids Res 27(1): 209-12; Ruiz M et al., (2000) Nucleic Acids Res 28(1): 219-21; Lefranc M P (2001) Nucleic Acids Res 29(1): 207-9; Lefranc M P (2003) Nucleic Acids Res 31(1): 307-10; Lefranc M P et al., (2005) Dev Compo Immunol 29(3): 185-203; Kaas Q et al., (2007) Briefings in Functional Genomics & Proteomics 6(4): 253-64) or the VBASE2 (Retter I et al., (2005) Nucleic Acids Res 33, Database issue D671-D674) or the Kabat database (Johnson G et al., (2000) Nucleic Acids Res 28: 214-218)) or publications (e.g., Kabat E A et al., supra) may be used to identify the human subfamilies to which the murine heavy and light chain variable regions belong and determine the best-fit human germline framework to use as the acceptor molecule. Selection of heavy and light chain variable region sequences (VH and VL) within these subfamilies to be used as acceptor may be based upon sequence homology and/or a match of structure of the CDR1 and CDR2 regions to help preserve the appropriate relative presentation of the six CDRs after grafting.

Searching of the IMGT database using IgBLAST (available on the NCBI website) indicated good homology between the 231-32-15 heavy chain variable region framework and members of the human heavy chain variable region subfamilies 1 and 7. Highest homologies and identities of both CDR and framework sequences were observed for germline sequence: IGHV1-2*02 (also known as DP75; SEQ ID NO: 601) (59.2% identity; 58 amino acid residues out of 98), IGHV1-3*01 (SEQ ID NO: 602) (58.2% identity; 57/98), IGHV1-46*01 (SEQ ID NO: 603) (57.1% identity; 56/98), IGHV1-18*01 (SEQ ID NO: 604) and IGHV1-69*01 (SEQ ID NO: 605) (both 56.1% identity; 55/98) and IGHV7-4-1*02 (SEQ ID NO: 606) (54.1% identity; 53/98).

Using the same approach, 231-32-15 light chain variable domain sequence showed good homology to the members of the human light chain variable domain kappa subfamilies 3 and 4. Highest homologies and identities of both CDRs and framework sequences were observed for germline sequences: IGKV4-1*01 (SEQ ID NO: 607) (79.2% identity; 80 amino acid residues out of 101) and IGKV3-7*02 (SEQ ID NO: 608) (64.4% identity; 65/101).

As a starting point to the humanization process, a CDR grafted version of mouse 231-32-15 VH was generated using human IGHV1-2*02 as human framework acceptor. A number of back mutations were made at residue positions that may affect the conformations of CDRs or inter-variable domain packing and therefore may be structurally important for maintaining the full activity of the antibody. In framework 1, residue Kabat H24 was kept as mouse because it is a canonical residue for CDR1 (loop of 5 amino acid residue long as defined by Kabat). It is a Gly in the murine sequence and an Ala in the human germline. In framework 2, residue Kabat H48 was kept mouse because it is known as a Vernier residue (i.e., in close proximity to CDRs). It is an Ile in the murine sequence and a Met in the human germline. In framework 3, residues Kabat H67 and 73, which are Vernier residues were kept mouse. H67 is an Ala in the murine sequence and Val in human IGHV1-2*02 germline. H73 is Lys in the murine sequence and Thr in human IGHV1-2*02 germline. Residue H71, which is a critical canonical residue for CDR2 has been kept mouse (it is an Arg in human germline and a Val in the murine sequence). Residue Kabat H94, which is a canonical residue for CDR1 has been kept mouse (it is an Arg in human germline and a Lys in the mouse sequence). The final humanized sequence was termed Version VH A (SEQ ID NO: 206) and had 79.6% identity (78 amino acid residues out of 98) with IGHV1-2*02 human germline.

A first CDR grafted version of mouse 231-32-15 VL was generated using human IGKV3-7*02 as human framework acceptor. Back mutations were considered at various residue positions and as a result in framework 3, residue Kabat L87 was kept mouse since it might play a critical role in the VH/VL interface. L87 is a His in the murine sequence and Tyr in IGKV3-7*02 human germline. The final humanized sequence was termed Version VK A1 (SEQ ID NO: 207) and had 81.2% identity (82 amino acid residues out of 101) with IGKV3-7*02 human germline.

A second CDR grafted version of mouse 231-32-15 VL was generated using human IGKV4-1*01 as human framework acceptor. Back mutations were considered at various residue positions and as a result in framework 3, residue Kabat L87 was kept as mouse since it might play a critical role in the VH/VL interface. L87 is a His in the murine sequence and Tyr in IGKV4-1*01 human germline. The final humanized sequence was termed Version VK A2 (SEQ ID NO: 208) and had 91.1% identity (92 amino acid residues out of 101) with IGKV4-1*01 human germline.

Table 10 shows residues (Kabat numbering) that differ between mouse and human antibody frameworks in the CDR grafted versions of mouse 231-32-15 VH and VL described above.

TABLE 10

Comparison of 231-32-15 and the human acceptor heavy chain variable IGHV1-2*02 and human acceptor light chain variable IGKV4-1*01 and IGKV3-7*02 framework.

| Heavy Chain Variable Region | | |
|---|---|---|
| Kabat position | 231-32-15 | IGHV1-2*02 |
| 24 | Gly | Ala |
| 48 | Ile | Met |
| 67 | Ala | Val |
| 71 | Val | Arg |

TABLE 10-continued

Comparison of 231-32-15 and the human acceptor heavy
chain variable IGHV1-2*02 and human acceptor light chain
variable IGKV4-1*01 and IGKV3-7*02 framework.

| | | |
|---|---|---|
| 73 | Lys | Thr |
| 94 | Lys | Arg |

Light Chain Variable Region

| Kabat position | 231-32-15 | IGKV4-1*01/ IGKV3-7*02 |
|---|---|---|
| 87 | His | Tyr |

6.2.3 Expression of Humanized Variants

The variable regions of IGHV1-2*02, IGK4-1*01 and IGK3-7*02 were synthesized by Life Technologies™ and cloned in standard expression vectors (pPEP), as described below. These constructs were subsequently used to transfect CHO cells and the expressed antibodies were tested using suspension array technology (Luminex® 200 system, Millipore) and surface plasmon resonance (BIAcore®, GE Healthcare) as described below. The term "variable region" in this Example means VDJ rearranged genes for the heavy chains IGHV1-2*02 and VJ rearranged genes for the light chains IGK4-1*01 and IGK3-7*02. The expression vector contained a CMV promoter, immunoglobulin constant region, WPRE element (posttranscriptional response element) and a BGH polyadenylation signal. Three different expression vector variants were used for cloning of the variable region IGHV1-2*02. Two expression vector variants contained different immunoglobulin constant regions—IGHG1 and IGHG4 and the third expression vector variant contained a fragment of IGHG1 to produce antibody Fab fragments. The variable regions of light chains IGK4-1*01 and IGK3-7*02 were cloned in an expression vector containing the IGKC immunoglobulin constant region.

6.2.3.1 Cloning in Expression Vectors for CHO Cell Transfection

Synthesised variable regions were cloned into a pPEP expression vector containing the appropriate immunoglobulin constant region. For the cloning of heavy chain variable regions of IGHV1-2*02, constructs 3592 (pPEP-InsX-Cg (iso3), 4192 (pPEP-InsX-IgG$_4$) and 4215 (pPEP-InsX-Fab-Xa-6xHis) ("6xHis" disclosed as SEQ ID NO: 36) were digested with HindIII/Eco47III at 37° C. for 4 hours. After digestion, the bands with a size of 4952 bp, 4952 bp and 4313 bp were gel-purified (Macherey & Nagel, NucleoSpin Gel and PCR cleanup). For the cloning of kappa light chain variable regions IGK4-1*01 and IGK3-7*02, construct 3593 (pPEP-Ins-Ck) was digested with HindIII/Eco47111 at 37° C. for 4 hours and the band with a size of 4474 by was gel-purified. The synthesized antibody variable regions were digested with HindIII/Eco47III at 37° C. for 4 hours and the bands with a size of 422 by (IGHV1-2*02) and 411 by (IGK4-1*01 and IGK3-7*02) were gel-purified.

The digested and purified variable antibody regions (IGHV1-2*02, IGK4-1*01, IGK3-7*02) were ligated in-frame into a pPEP vectors (50 ng) containing the appropriate immunoglobulin constant regions. Ligation was performed overnight at 16° C. with a vector to insert ratio of 1:3. Afterwards 1 µl of ligation reaction was electroporated into DH10B cells (*E. coli* ElectroMax DH10B electrocompetent cells, Invitrogen) (1900V/5 ms). Then 5-50 µl of the electroporated bacteria were plated onto LB-agar+100 µg/ml ampicillin plates. From each construct about 2-3 colonies were picked and grown overnight.

From each clone a DNA plasmid preparation in a small-scale was performed (Macherey & Nagel, NucleoSpin Plasmid). A digestion to verify the presence and the correct size of the cloned insert was performed with HindIII/Eco47111 (H/E) and an ApaLI (A) digestion was used to verify the correct vector backbone. The vector integrity was tested by separation of uncut plasmid DNA. From each positive clone and DNA, the preparation was up-scaled, control digested and sequenced using primer 892-Je (Sequence: 5' gaccaata-gaaactgggcttgtc 3'; SEQ ID NO: 705). Each construct received a construct number, as a unique identifier and glycerol stock was prepared.

TABLE 11

Construct characterization in expression vectors

| | | Construct characterization |
|---|---|---|
| Construct number | Insert | Immunoglobulin constant regions |
| 4260 | IGHV1-2*02 | IGHG1 |
| 4261 | IGK3-7*02 | IGKC |
| 4262 | IGK4-1*01 | IGKC |
| 4379 | IGHV1-2*02 | IGHG4 |
| 4336 | IGHV1-2*02 | IGHG1-Fab |

6.2.3.2 Cloning in Retroviral Expression Vectors

The variable regions of IGHV1-2*02, IGK3-7*02 and IGK4-1*01 were synthesised by Life Technologeis™ and cloned into retroviral expression vectors (pCMA). These constructs were subsequently used to transduce preB cells and to express antibodies on the surface using Retrocyte Display® technology. The retroviral expression vector contained MSCV based 5' and 3' LTR's, immunoglobulin constant region (IGHG1 or IGKC) comprising membrane anchor fraction (IGHG1) and a CD8 surface marker gene.

Synthesised variable regions were cloned into a retroviral expression vector containing the appropriate immunoglobulin constant region. For the cloning of the heavy chain variable region, construct 3956 (pCMA-InsX Cg(iso3) loxP2-I-tr_huCD8-loxP) was digested with HindIII/Eco47III at 37° C. for 4 hours and the band of size of 7616 bp was gel-purified. For the cloning of kappa light chain variable regions, construct 3957 (pCMA-InsX Ck-I-tr_huCD8) was digested with HindIII/Eco47111 at 37° C. for 4 hours and the band of size of 6718 by was gel-purified. The synthesized antibody variable regions were digested as described in Section 6.2.1 above.

The digested and purified variable antibody regions were ligated in-frame into retroviral expression vectors (50 ng) containing the appropriate immunoglobulin constant regions. Ligation, transformation and clone verification were performed as described in Section 6.2.3.1 above. The up-scaled DNA plasmid preparations were sequenced using primer 327-Je (Sequence: 5' ctcgatcctcccttttatccag 3'; SEQ ID NO: 706). Each construct received a construct number, as a unique identifier and glycerol stock was prepared.

TABLE 12

Construct characterization in retroviral expression vectors

| | | Construct characterization | |
|---|---|---|---|
| Construct number | Insert | Immunoglobulin constant regions | Surface marker |
| 4257 | IGHV1-2*02 | IGHG1 | CD8 |
| 4258 | IGK3-7*02 | IGKC | CD8 |
| 4259 | IGK4-1*01 | IGKC | CD8 |

6.2.4 Expression of Recombinant Antibodies

Recombinant antibodies were expressed by transient transfection of FreeStyleCHO-S cells (Invitrogen, R800-07) in suspension. Briefly, cell density was adjusted to 8×10$^6$ cell/ml in PowerCHO2 medium (Lonza, 12-771Q) supplemented with 4 mM L-glutamine (Biochrom, K 0283) and 1×HT supplement (GIBCO, 11067-030). DNA corresponding to antibody light chain (2.5 µg/ml) and heavy chain (2.5 µg/ml) was added to the cell suspension with slight agitation. Following DNA addition, the cell suspension was supplemented with 10 µl/ml of TransIT-Pro transfection reagent (MIRUS, MIR5700) and 0.5 mM (final concentration) valproic acid (Sigma-Aldrich, P4543). The cell suspension was incubated for 6 days at 31° C., 8% $CO_2$ with shaking (200 rpm).

The culture supernatant was harvested by centrifugation (9000 g, 10 min at 10° C.) and filtered through a 0.45 µm filter. A Vivaspin 20 ultrafiltration device (Sartorius, VS2032, MWCO 50 kDa) was used to concentrate the supernatant to final volume of 0.6 ml at 1000 g, 10° C. for approximately 60 minutes. For purification of recombinant antibody a protein A HP Spin Trap column (GE Healthcare, 28-9031-32) was equilibrated with binding buffer (20 mM phosphate buffer pH 7.0) and 0.6 ml of concentrate was loaded. The column was sealed with a lid and incubated on an end-over-end mixer at room temperature. After 30 min, the column was washed 2× by application of 600 µl binding buffer and subsequent centrifugation at 100 g for 1 minute. Bound recombinant antibody was eluted from the spin column by adding 400 µl elution buffer (100 mM glycine, pH 2.0) and centrifugation at 100 g for 1 minute. Eluates were immediately neutralised with 40 µl of neutralisation buffer (1M Tris-HCl, pH 9.0). Purified recombinant antibody was stored in protein LoBind tubes (Eppendorf, 0030 108.116) at 4° C. until further processing for characterisation studies.

For quantification, cell culture supernatants and purified samples containing human IgG were diluted in assay buffer (Roche, 11112589001) and dilutions were assessed in duplicate in a 96-half well plate (Corning, 3884). Briefly, 25 µl samples were incubated in the dark (20° C., 650 rpm) for 1 hour with 5 µl containing 1200 Luminex-COOH-beads loaded by amine coupling with goat anti-human IgG, F(ab')$_2$ fragment specific (Jackson ImmunoResearch, 109-006-09). Standard curves were generated using duplicates of 25 µl of a 1:3 dilution series (0.08-60 ng/ml) of ChromPure human IgG whole molecule (Jackson ImmunoResearch, 009-000-003). Detection was performed by the addition of 30 µl anti-human IgG, Fc-specific labeled with R-PE (5 µg/ml; Jackson ImmunoResearch, 109-116-098) and further incubation for 1 h. Plates were read and analysed using a Luminex® 200 instrument (Millipore) using the following settings: 100 beads, 50 µl sample size.

Quality control of purified samples included analysis by SDS-PAGE and size exclusion chromatography (SEC) on HPLC. SDS-PAGE analysis was performed under reducing and non-reducing conditions on 12% and 8% polyacrylamide gels, respectively, following the protocol of Laemmli (Laemmli UK (1970) Nature, 227(5259): 680-5). Polyacrylamide gels were stained with Commassie brilliant blue solution for visualization. SEC was performed on an Agilent Infinity 1260 system (Agilent Technologies) equipped with a binary pump, degassing unit, automatic sampling unit and UV diode array detector. For separation Zenix-C 300 column (3 µm particle size, 4.5×300 mm, Sepax, 233300-4630) was used. 3 µg of each sample was loaded and separated in 100 mM phosphate buffer pH 7.0 (supplemented with 150 mM NaCl) at 0.3 5 ml/min for 15 minutes and detection was at 220 nm.

6.2.5 Characterization of Humanized Variants

The binding properties of both humanized variants (Hum231#1: IGHV1-2*02 and IGK3-7*02; Hum231#2: IGHV1-2*02 and IGK4-1*01) and the chimeric parental antibody 231-32-15 were characterized in a number of assays as described below.

6.2.5.1 Quantification and Binding Analysis by Suspension Array Technology

Purified material of both humanized variants and the chimeric parental antibody 231-32-15 was diluted in assay buffer (Roche 11112589001) 1:10,000 and 1:100,000. Briefly, 25 µl of each dilution was incubated in the dark (20° C., 650 rpm) with 1500 Luminex® beads (in 5 µl assay buffer) for 1 hour in 96 half-well filter plates (Millipore, MABVN1250). Luminex® beads (Luminex Corp, #5 LC10005-01 and #14 LC10014-01) were either coupled with anti-human IgG (F(ab)$_2$-specific, JIR, 105-006-097) or GITR antigen (R&D systems, di-sulfide-linked homodimer; 689-GR) via amine coupling with COOH bead surface. Standard curves were generated using duplicates of 25 µl of ChromPure IgG whole molecule (JIR, 009-000-003) with 1:3 dilution series (0.08-540 ng/ml) for IgG$_1$ versions. For antibodies in IgG$_4$ format, a different standard was used—purified Immunoglobulin (Sigma, 14639). Detection was performed using 60 µl of goat anti-human IgG F(ab)$_2$ labeled with R-PE (2.5 µg/ml; JIR 109-116-098, AbDSerotec Rapid RPE Antibody Conjugation Kit, LNK022RPE) and 1 hour of incubation time (20° C., 650 rpm). Plates were analyzed using a Luminex® 200 system (Millipore). A number of 100 beads were counted per well in 48 µl sample volume. Relative affinities were calculated in relation to the MFI values of the chimeric parental 231-32-15 antibody (set to 100% binding) and according to IgG values present in the sample. Both humanized variants showed relative affinities near to 100%.

6.2.5.2 Ligand Blocking Activity Using Suspension Array Technology

To determine whether anti-GITR antibodies blocked binding of ligand (GITRL) to GITR, a ranking assay setup was performed using suspension array technology. 1200 Luminex® beads in Sul assay buffer (Luminex Corp, #14 LC10014-01) were added to each well of 96-well half area plates (Corning, Inc., 3884). The beads were coupled with GITR antigen (R&D systems, di-sulfide-linked homodimer; 689-GR) via amine coupling with COOH bead surface. The coupling reaction was performed using 50 µg/ml of GITR antigen and 1×10$^7$ Luminex beads per ml. Standard NHS ester chemistry was used to form carbodiimide bonds between the primary amine groups of the antigen and the carboxyl groups on the bead surface (Luminex Xmap cookbook chapter 3).

Antigen coupling for proteins is a simple two-step carbodiimide procedure during which microsphere carboxyl groups are first activated with EDC (1-Ethyl-3-[3-dimethylaminopropyl]carbodiimide hydrochloride) reagent in the presence of Sulfo-NHS (N-hydroxysulfosuccinimide) to form a sulfo-NHS-ester intermediate. The reactive intermediate is then replaced by reaction with the primary amine of the target molecule (antibody, protein or peptide) to form a covalent amide bond. The coupled beads were incubated with different concentrations of anti-GITR antibodies (concentrations of 9000 ng/ml to 12 ng/ml in 25 µl assay buffer per well) for 1 h at 20° C. and 650 rpm. Afterwards 30 µl of R-PE labeled GITR-ligand (concentration 1 nM; monomeric, R&D systems 694-GF/CF) was added to each well, giving a total well volume of 60 µl (1200 beads per well and a final concentration of 0.5 nM of labeled GITRL). The labeling of the ligand was done in-house using R-PE labeling kits (AbDSerotec, LYNX Rapid RPE Antibody Conjugation Kit, LNK023RPE) according to the manufacturer's protocol. Plates were analyzed using a Luminex® 200 system (Millipore). A number of 100 beads were counted per well in 50 µl sample volume. Ligand blocking potential was calculated using the MFI values of the non-competed signal (100% binding) of the ligand only control. A PE detectable signal indicated ligand binding to the antigen.

Figure 5:
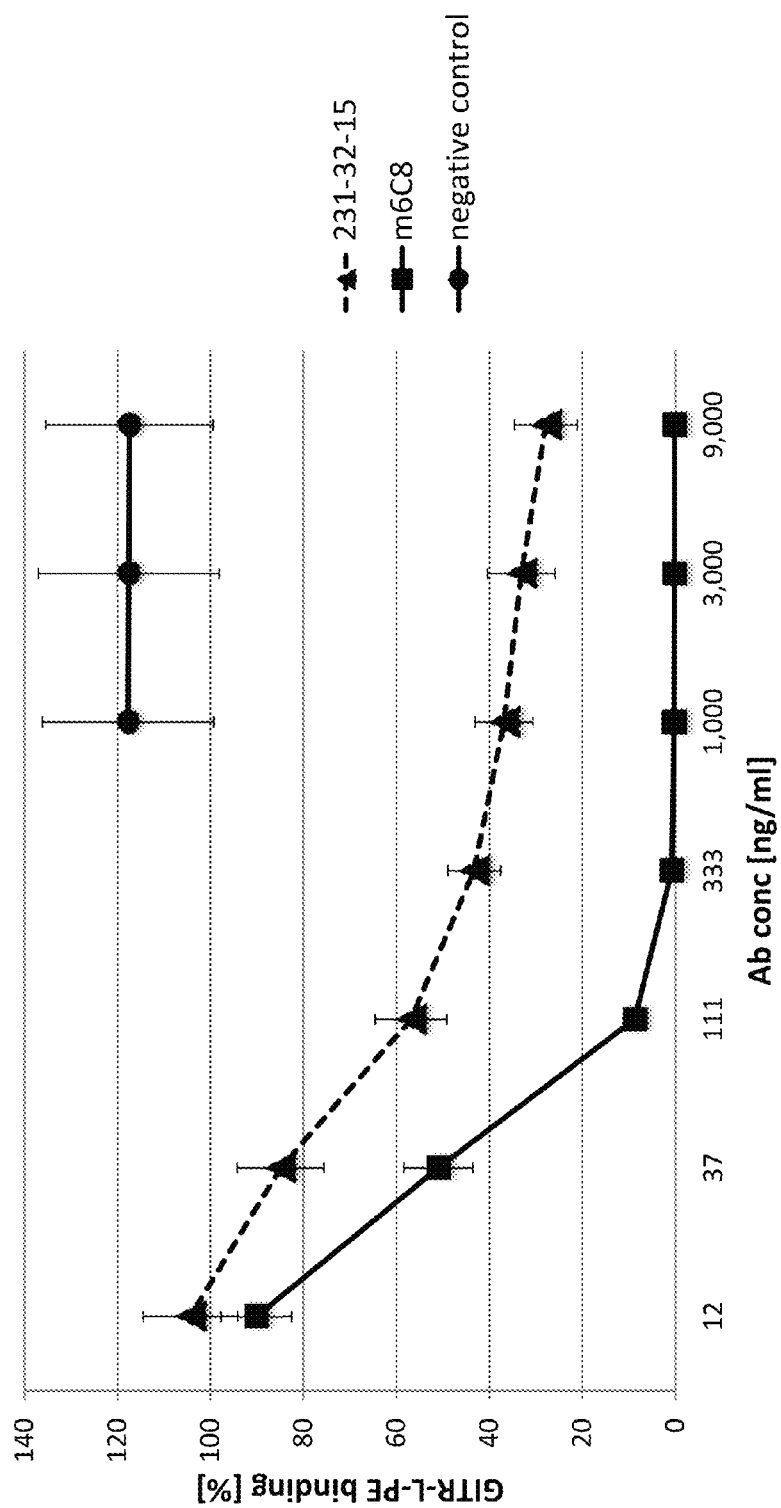

In a first assay, the anti-GITR antibodies chimeric parental 231-32-15 and m6C8 (WO 06/105021) as well as a control antibody recognising IL-1β (SK48E26; International Publication No. WO 95/001997) were tested. The antibody m6C8 was an IgG1 antibody generated based on the variable regions of the antibody 6C8 provided in WO 06/105021 (herein incorporated by reference). The heavy chain of m6C8 comprises the amino acid sequence of SEQ ID NO: 585. The light chain of m6C8 comprises the amino acid sequence of SEQ ID NO: 586. Results of this assay are shown in FIG. 5, where it can be observed that at concentrations of the 6C8 antibody above 333 ng/ml, no PE signal was detected and therefore no binding of GITRL to GITR occurred. In contrast, for the chimeric parental 231-32-15 antibody, at all concentrations tested, a PE signal was detected indicating that GITRL was still able to bind to GITR when the chimeric parental 231-32-15 antibody was also bound to GITR. The data shown in FIG. 5 are from four repeats of this assay, performed in duplicate, with the standard deviation calculated for n=8.

Figure 6:
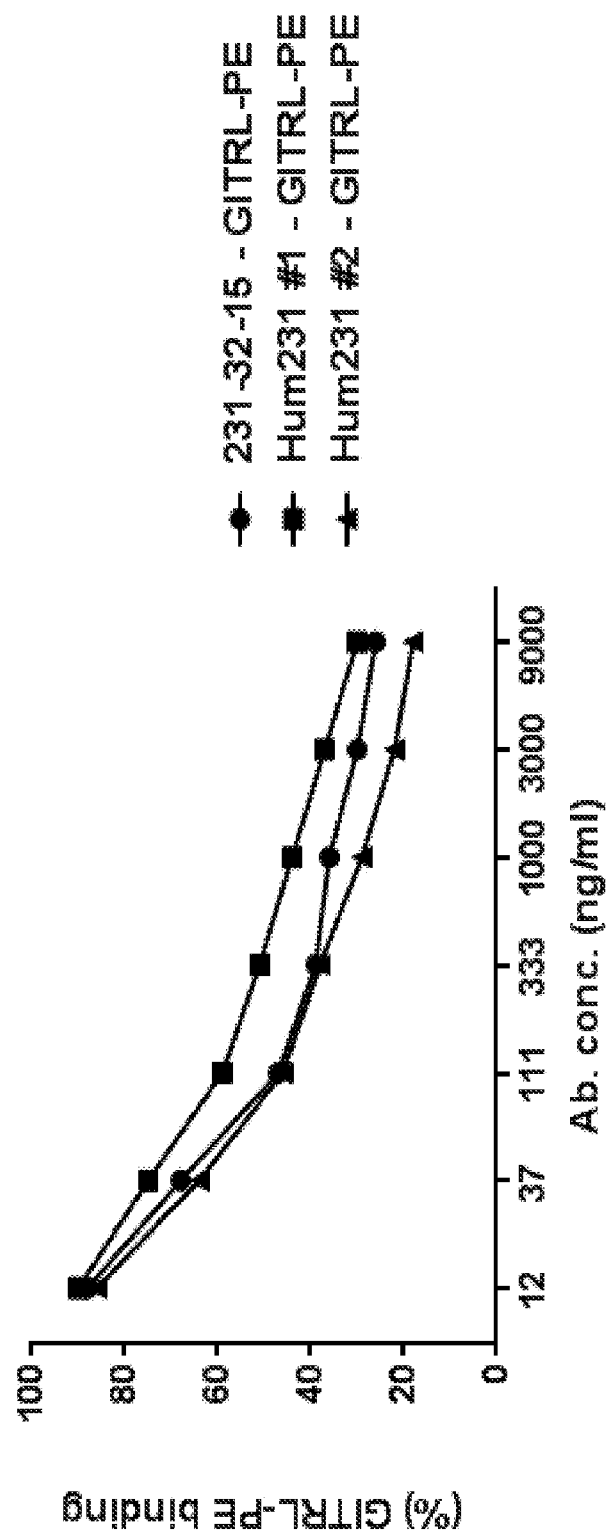

In a second assay, GITRL-PE binding to GITR was tested in the presence of the chimeric parental 231-32-15 anti-GITR antibody and the humanized variants Hum231#1 and Hum231#2. FIG. 6 shows that these three anti-GITR antibodies when bound to GITR, still allow the binding of GITRL to GITR and all three antibodies show comparable ligand blocking activity.

6.2.5.3 Kinetic Analysis by Surface Plasmon Resonance

Surface plasmon resonance was used to determine the affinity of the humanized variants and the chimeric parental 231-32-15 antibody (BIAcore® T100/T200 sensitivity enhanced system (GE Healthcare) and a Fab-capture assay). All interactions were analyzed at 25° C. using 1×DPBS (PAA, H15-002) plus P20 (0.05%, Pierce, 28320) as running buffer. Anti-GITR antibodies (8 µg/ml in running buffer) were captured to the chip surface of a CM5 sensor chip (GE Healthcare, Series S CM5, BR-1005-30) via an immobilized anti-human Fab antibody (GE Healthcare, Fab Capture Kit, 28958325). To detect unspecific interactions of the GITR antigen, antibody capture was only performed in flow cell 2, whereas in flow cell 1 only the capturing antibody was immobilized. In addition, an unrelated antibody (anti-IL-1β; SK48E26; International Publication No. WO 95/001997) was used to assess specificity of GITR binding. After capture of the anti-GITR antibodies GITR antigen (R&D systems, di-sulfide-linked homodimer; 689-GR) was run through both flow cells in different amounts (40 nM, 10 nM and 2.5 nM) for each antibody. Also a blank curve (running buffer only) was included in each run. Association was run for 90s and dissociation for 600s with a flow rate of 10 µl/min. After each run a regeneration step was performed with 10 mM Glycine pH2.0 (GE Healthcare, BR-1003-55) for 60s with 30 µl/min. Binding curves were evaluated using BIAcore® T200 evaluation software version 2.0.1 applying a Langmuir 1:1 model with global fit of Rmax.

From these values an affinity value ($K_D$ (M)) was calculated and the values are shown in Table 13 below. The humanized variants Hum231#1 and Hum123#2 showed improved on-rates but decreased off-rates resulting in $K_D$ values of 0.7 nM and 0.6 nM, respectively. The chimeric parental 231-32-15 antibody had an affinity of 2 nM.

TABLE 13

Summary of on- and off-rates and calculated $K_D$ (M)

| anti-GITR antibody | $k_{on}$ (1/Ms) | $k_{off}$ (1/s) | $K_D$ (M) |
|---|---|---|---|
| Chimeric parental 231-32-15 | 3.52E+05 | 7.12E−04 | 2.02E−09 |
| Hum231#1 | 3.55E+06 | 2.49E−03 | 7.02E−10 |
| Hum231#2 | 2.83E+06 | 1.78E−03 | 6.29E−10 |

6.2.5.4 Ligand Blocking Analysis by Surface Plasmon Resonance

Both humanized variants Hum231#1 and Hum231#2 were expected to show the same ligand blocking kinetics as the chimeric parental 231-32-15 antibody. This was confirmed using a ligand blocking assay as measured by surface plasmon resonance (BIAcore® T100/T200 sensitivity enhanced system (GE Healthcare)).

In a first experiment binding of GITR ligand to immobilized GITR antigen was evaluated. GITR antigen (R&D systems, disulfide-linked homodimer; 689-GR) was immobilized at high density (4371 RU) on a CM5 sensor chip (GE Healthcare, Series S CM5, BR-1005-30). In another flow cell ovalbumin (1289 RU, Pierce ThermoFisher 77120) was immobilized for reference. Immobilization was performed according to a standard protocol from the manufacturer (GE Healthcare) for amine coupling (activation of surface with 0.4 M EDC and 0.1 M NHS, GE Healthcare Amine coupling kit, BR-1000-50). Unreacted groups were inactivated with 1M ethanol-amine-HCl pH 8.5. Afterwards two GITR ligands (monomer R&D, 694-GL and non-covalently linked homotrimer R&D, 6987) were run through the chip surface in different amounts (500 nM, 250 nM and 125 nM) to determine saturating conditions. An association time of 240s and a dissociation time of 300s were used with a flow rate of 5 µl/min. Regeneration of the chip surface was done using 10 mM Glycine pH2.0 (GE Healthcare, BR-1003-55) for 60s at 10 µl/min. Most favourable saturating conditions were achieved with the GITR trimeric ligand at 125 nM and this setup was therefore used with anti-GITR antibodies at the same amount. In another experiment, the reverse setup was used so that the anti-GITR antibodies (125 nM) were first bound to the GITR antigen on the chip and the GITR ligand (non-covalently linked trimer at 125 nM) was added afterwards.

Figure 7:
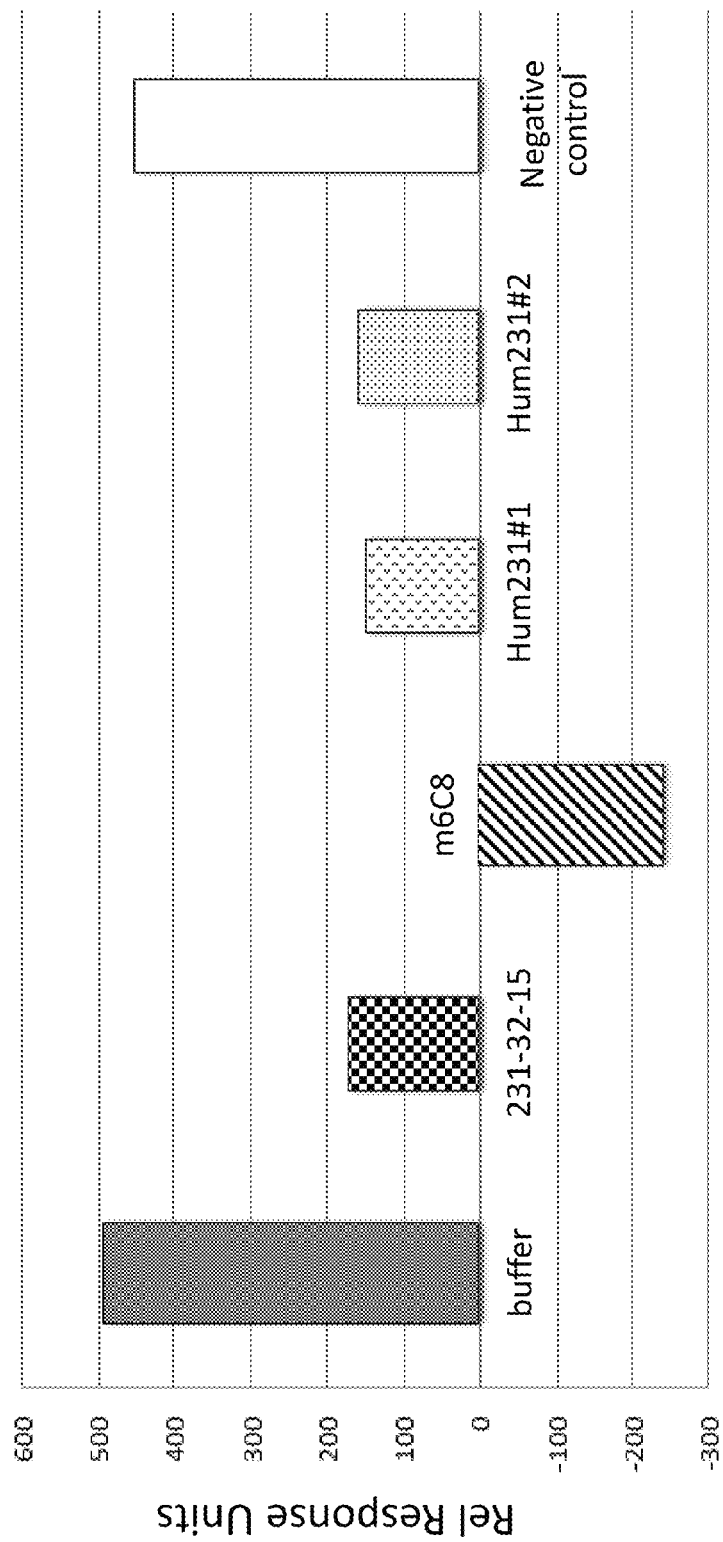

As is shown in FIG. 7, when GITR antigen was immobilized on the chip and GITRL was added in the presence of the anti-GITR antibodies chimeric 231-32-15 antibody, Hum231#1 and Hum231#2, binding of GITRL was observed. In contrast, no binding of GITRL was observed in the presence of the anti-GITR antibody m6C8. These data indicate that chimeric 231-32-15 antibody, Hum231#1 and Hum231#2 do not inhibit human GITR from binding to GITRL.

6.3 Example 3: Functional Characterisation of Humanized Antibodies

This example demonstrates the ability of the humanized anti-GITR antibodies generated by the methods described above to function as an agonist of GITR. The anti-GITR antibody Hum231#2 comprises a heavy chain comprising the amino acid sequence of SEQ ID NO: 567 and a light chain comprising the amino acid sequence of SEQ ID NO: 587. The antibody Hum231#2 is a human IgG1 antibody containing a T109S substitution (i.e., substitution of threonine with serine at position 109 relative to the wild type Fc sequence), numbered according to Kabat, in the light chain constant domain, which facilitates the cloning of the variable region in frame to the constant region. This mutation is a conservative modification that does not affect antibody binding or function. The wild type counterpart, named Hum231#2w, which contains a threonine at position 109, numbered according to Kabat, was also generated. The antibody Hum231#2w is a human IgG1 antibody comprising a heavy chain of SEQ ID NO: 567 and a light chain of SEQ ID NO: 576.

These anti-GITR antibodies were also assayed to determine their ability to costimulate primary human CD4+ or CD8+ T-cells. This work, as described in Section 6.3.1 to 6.3.3 and 6.3.7 below, was performed with materials from multiple donors. Human leukocytes used in screening and testing of candidate antibodies were procured from the New York Blood Center (New York City).

The functional activity of anti-GITR antibodies was demonstrated on enriched CD4 positive (a.k.a. CD4+ T cells, CD8 positive (a.k.a. CD8+) T cells and PBMCs. For human T-cell proliferation studies, freshly prepared, donor packed leukocytes were collected and processed using sterile tissue culture techniques. Leukocytes were processed to harvest mononuclear immune cells (PBMC) by density gradient (Lymphocyte Separation Media, Corning). PBMCs are located in the buffy coat layer of Ficol density gradient.

Enriched CD4 cells were prepared from PBMC by negative selection using RosetteSep® Human CD4+ T Cell Enrichment Cocktail (Stemcell Technologies, Vancouver, BC Canada). The enriched CD4+ T-cell preparations were separated from red blood cells by density centrifugation over Lymphocyte separation media (Corning). Collected cells were washed and aliquoted for storage in liquid nitrogen. To account for variability in donor's response to stimulation, varying concentrations of anti-CD3 were used to adjust donor-specific capability to response. Therefore, prior to screening anti-GITR antibodies, the buffy coats were assessed for their capability for cytokine release and proliferation in response to CD3 stimulation with titrated levels of anti-CD3 (Clone SP34; BD Pharmingen; concentration ranging from 31.5 ng/ml to 250 ng/ml), with or without reference anti-GITR chimeric parental 231-32-15 antibody to establish baseline T-cell proliferation and their cytokine production and determine appropriate stimulation conditions for each donor buffy coat.

6.3.1 Effect of Agonistic Anti-GITR Antibodies on Anti-CD3 Stimulated CD4+ T Cell Proliferation Anti-GITR antibodies were assessed for agonist activity by their costimulation of CD4+ T cells. The agonistic activity of chimeric parental 231-32-15 antibody was compared to the two humanized versions: Hum231#1 and Hum231#2. The costimulation assay was performed as follows: For plate bound stimulation conditions, anti-CD3 antibodies, anti-GITR antibodies and where indicated isotype control, were coated on flat bottom or round bottom sterile tissue culture plates for two hours and excess antibodies were removed through washing. For soluble costimulation conditions, anti-CD3 antibody was coated onto a plate while costimulation with anti-GITR antibodies was provided in solution. Tested anti-GITR antibodies were Hum231#1 and Hum231#2, chimeric parental 231-32-15 antibody (a.k.a REF-231) or negative isotype controls (pAB 1915). Additionally, for plate bound and soluble costimulation conditions, anti-CD28 antibody (125 ng/ml; BD Pharmingen) and 10U IL-2 were also provided in solution.

Cellular proliferation was determined by monitoring dilution of carboxyfluorescein diacetate sucinimidyl ester (CFSE) dye within divided cells (Quah B J et al., (2007) Nat Protoc, 2(9): 2049-56). The enriched CD4+ T cells were labeled with 1-2 µM CFSE. CFSE-labeled CD4+ enriched T cells were washed and then stimulated with plate bound anti-CD3 (125 ng/ml), soluble anti-CD28 (125 ng/ml) and 10 U IL-2, together with 5 µg/ml or 10 µg/ml plate bound anti-GITR antibodies or no antibody. The cells were allowed to divide for 3 to 6 days in culture at 37° C. depending on optimal activation of each donor cell at which point culture supernatants and cells were collected from the plate.

Figure 8A:
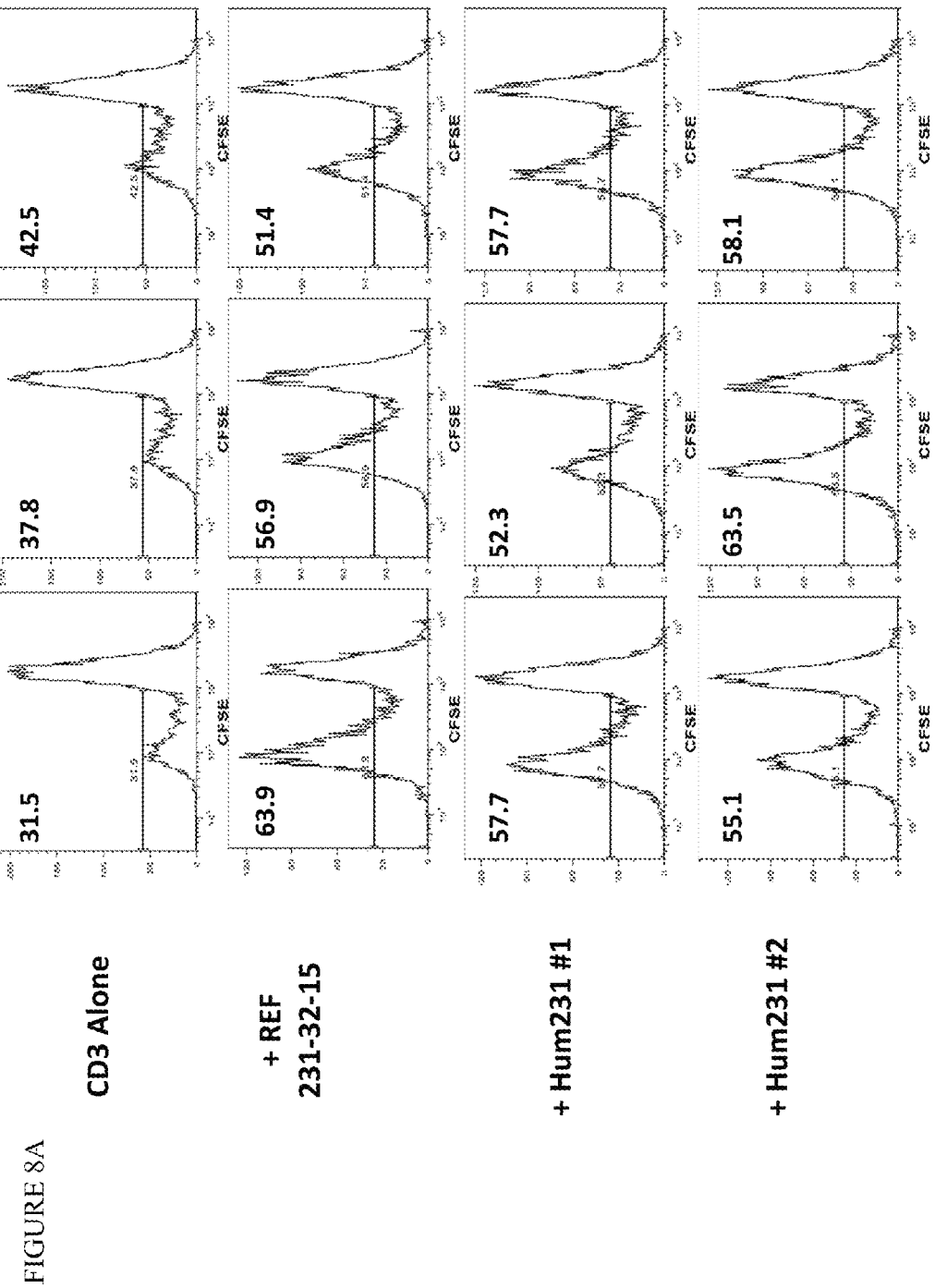
Figure 8B:
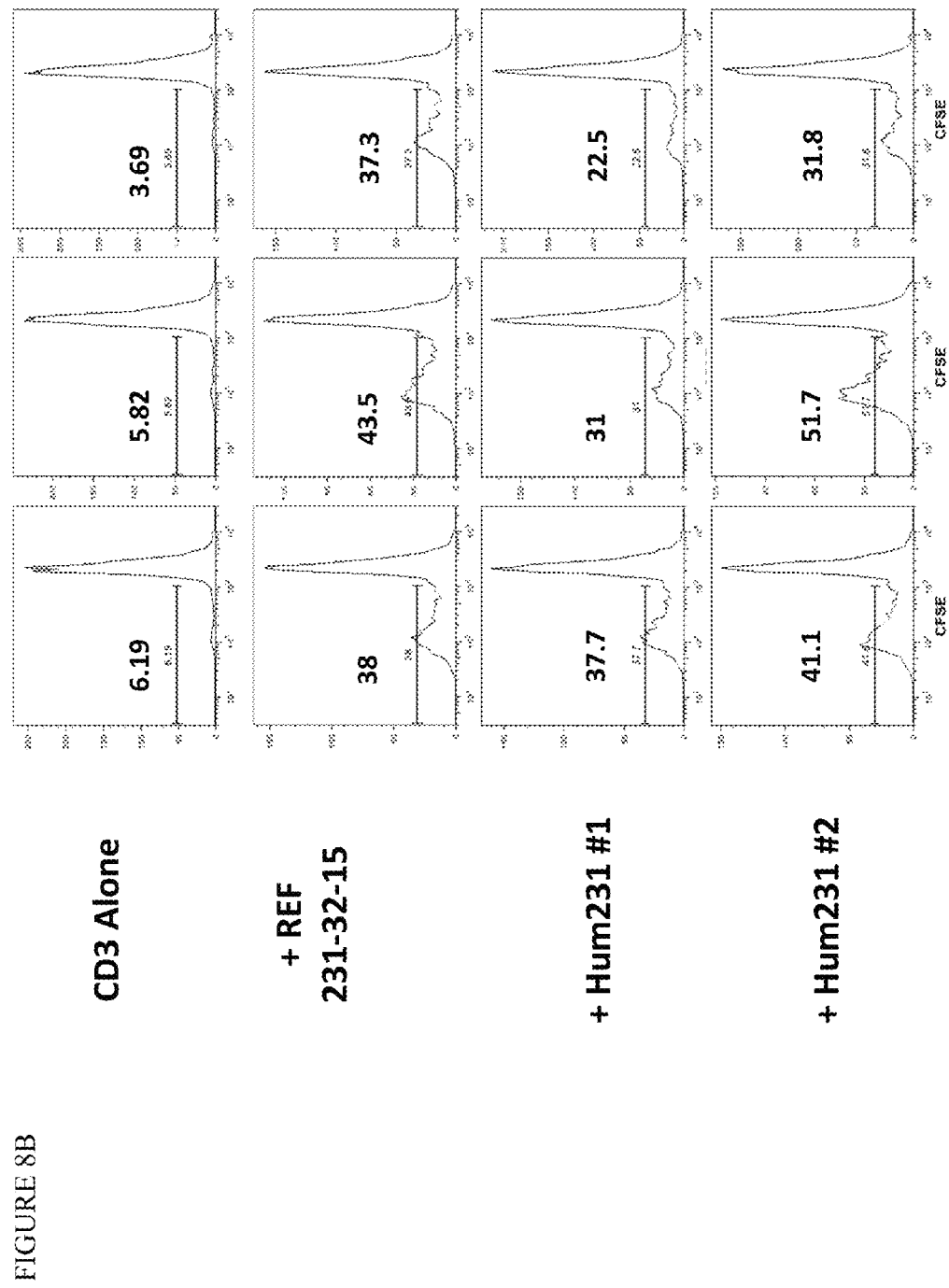

FIGS. 8A and 8B show a representative FACS analysis of CD4+ T cell proliferation induced by costimulation with anti-GITR antibodies performed in triplicate on buffy coat 6 and buffy coat 8, respectively. These figures show cell numbers (Y-axis) and the level of fluorescence emitted (X-axis) by the CFSE labeled CD4+ T cells. 10 µg/ml anti-GITR antibodies (chimeric parental 231-32-15 (REF 231-32-15), Hum231#1 and Hum231#2) were used. Enhanced CD4+ T cell proliferation is shown by an increased percentage of cells with a diminished level of fluorescence emitted by CFSE (CFSE low). FIGS. 8A and 8B illustrate that anti-GITR antibodies (chimeric parental 231-32-15 (REF 231-32-15), Hum231#1 and Hum231#2) demonstrated agonistic activity when added to cells activated with suboptimal concentrations of anti-CD3 antibody for both high responding cells (buffy coat 6, FIG. 8A) and even for low responding cells (buffy coat 8; FIG. 8B).

Figure 9A:
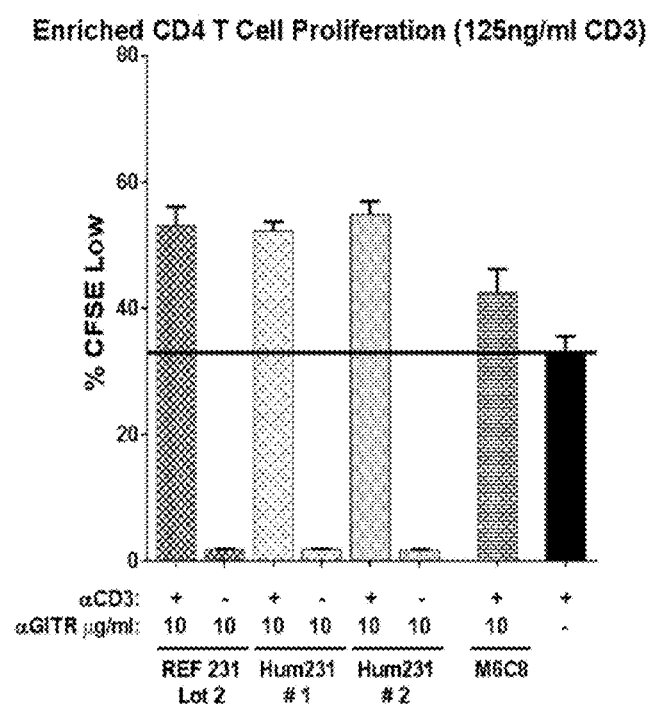
Figure 9B:
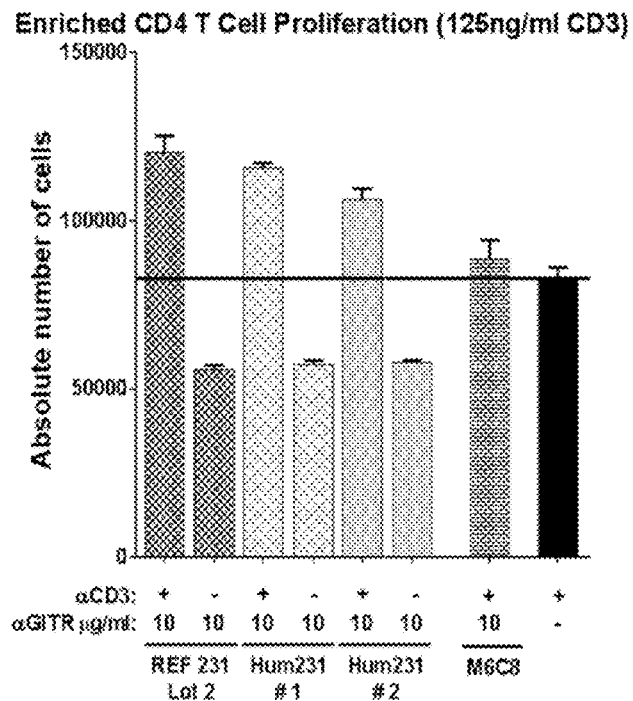
Figure 10A:
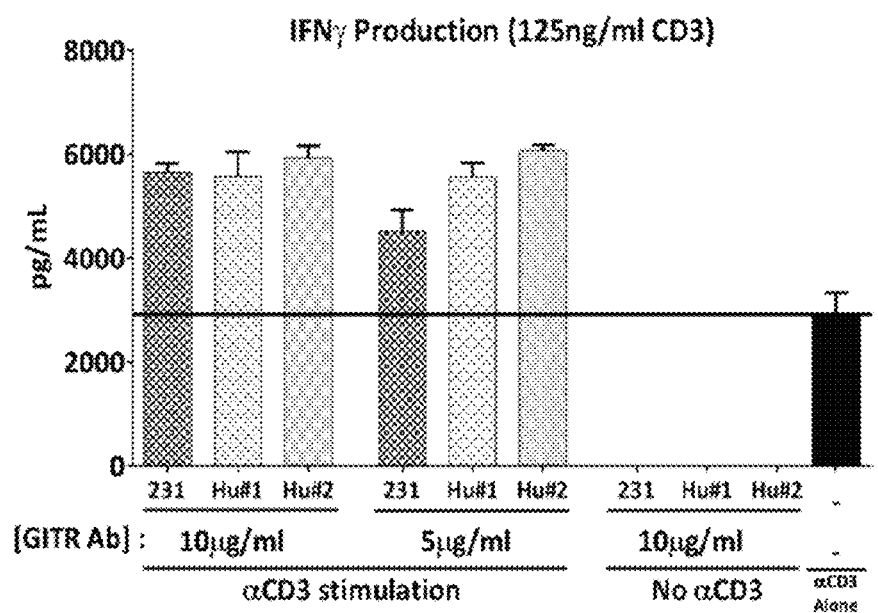
Figure 10B:
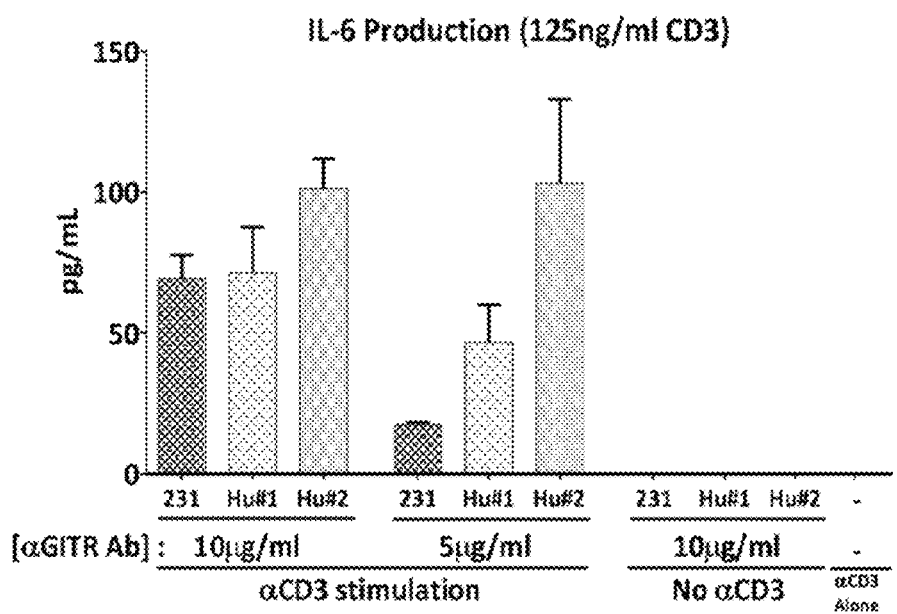
Figure 10C:
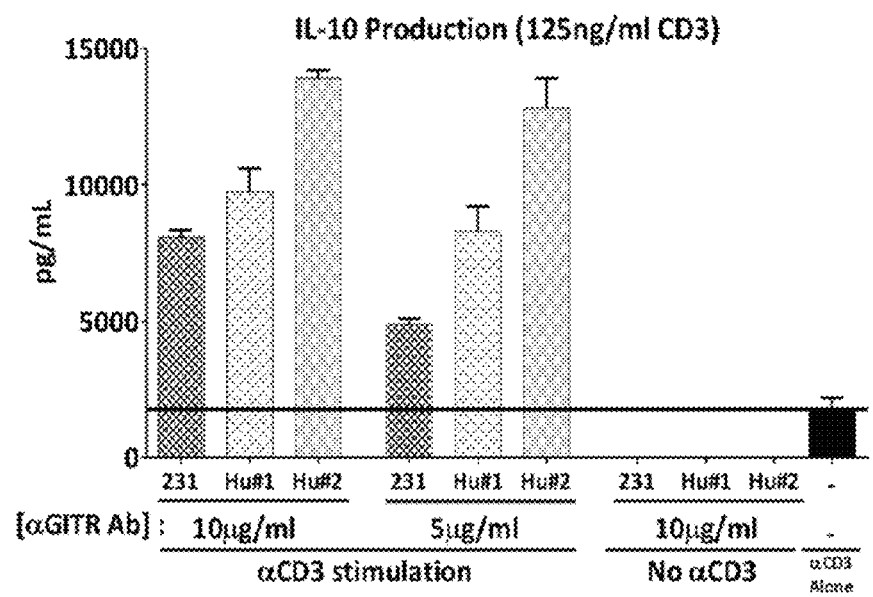
Figure 10D:
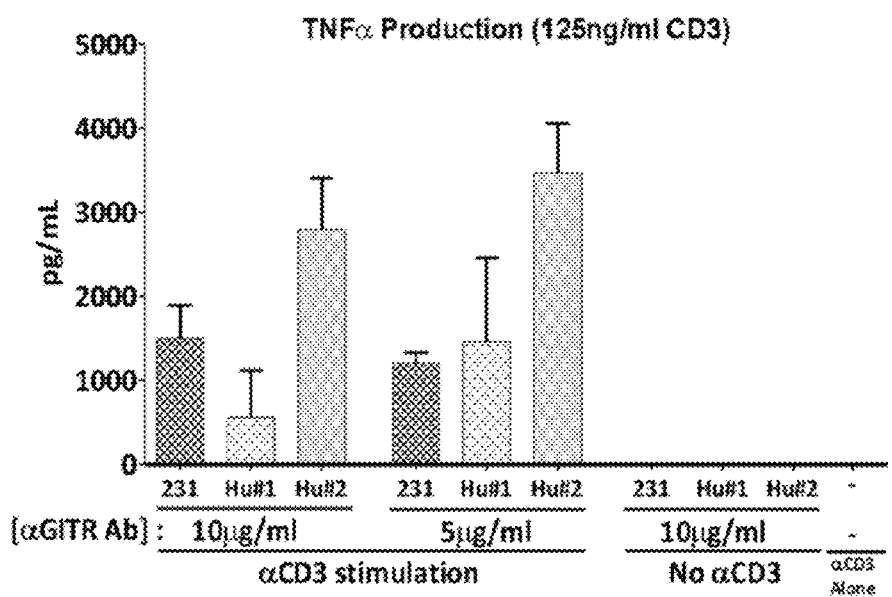

FIGS. 9A and 9B are histogram plots of the representative results from the above study for plate bound anti-GITR antibodies (chimeric parental 231-32-15 antibody, Hum231#1, Hum231#2, and m6C8) at a concentration of 10 µg/ml. In the example shown in FIG. 9A, costimulation with Hum231#1 or Hum231#2 induced CD4+ T cell proliferation at 10 µg/ml. Approximately greater than 50% of CD4+ T cells proliferated (CFSE low cells) when costimulated with 10 µg/ml Hum231#1 or Hum231#2. In contrast, under anti-CD3/anti-CD28 stimulation without anti-GITR antibody-mediated costimulation, only approximately 35% of CD4+ T cells proliferated (CFSE low cells). FIG. 9B illustrates that the addition of anti-GITR costimulation to anti-CD3/anti-CD28-mediated stimulation also caused an increase in the absolute number of CD4+ T cells in culture over 5 days as compared to stimulation with anti-CD3/anti-CD28 alone. For example, stimulation with anti-CD3/anti-CD28 in conjunction with 10 µg/ml antibody chimeric parental 231-32-15 antibody (REF 231) caused GITR costimulation induced expansion of CD4+ T cell numbers from $7.5 \times 10^4$ to $12.0 \times 10^4$.

Additionally, Hum231#1-mediated costimulation at 10 µg/ml also induced expansion of CD4+ T cells from $7.5 \times 10^4$ to $11.5 \times 10^4$. At 10 µg/ml concentration of antibody, costimulation by Hum231#2 also induced proliferation of CD4+ T cells from $7.5 \times 10^4$ to $10.6 \times 10^4$. Notably, costimulation of CD4+ T-cells with 10 µg/ml of m6C8 (International Publication No: WO 06/105021) did not cause additional increases in the absolute number of cells after 5 days of culture over that seen with anti-CD3/anti-CD28 stimulation alone.

6.3.2 Effect of Agonistic Anti-GITR Antibodies on Anti-CD3 Induced CD4+ T-cell Cytokine Production As further evidence for the agonistic costimulatory activity of anti-GITR antibodies, cytokines (IFNγ, IL-6, TNFα, and IL-10) released by CD4+ T cells were measured by multiplex ELISA (Flowcytomix, FACS bead based cytokine ELISA, eBioscience). Supernatants harvested from proliferation assays were collected and used for cytokine analysis. FIGS. 10A to 10D show the effect of 10 µg/ml or 5 µg/ml of chimeric parental 231-32-15, Hum231#1 or Hum231#2 anti-GITR antibodies on cytokine production by human CD4+ T cells. The addition of either 10 µg/ml or 5 µg/ml of chimeric parental 231-32-15 antibody, Hum231#1 or Hum231#2 to anti-CD3/anti-CD28 stimulated T-cells significantly increased the production of IFNγ, TNFα, IL-10 and IL-6 when compared to anti-CD3/anti-CD28 stimulus alone. No costimulatory activity was observed for agonistic anti-GITR antibodies in the absence of anti-CD3/anti-CD28 stimulus.

6.3.3 Titration of Humanized 231-32-15 Clones

Figure 11:
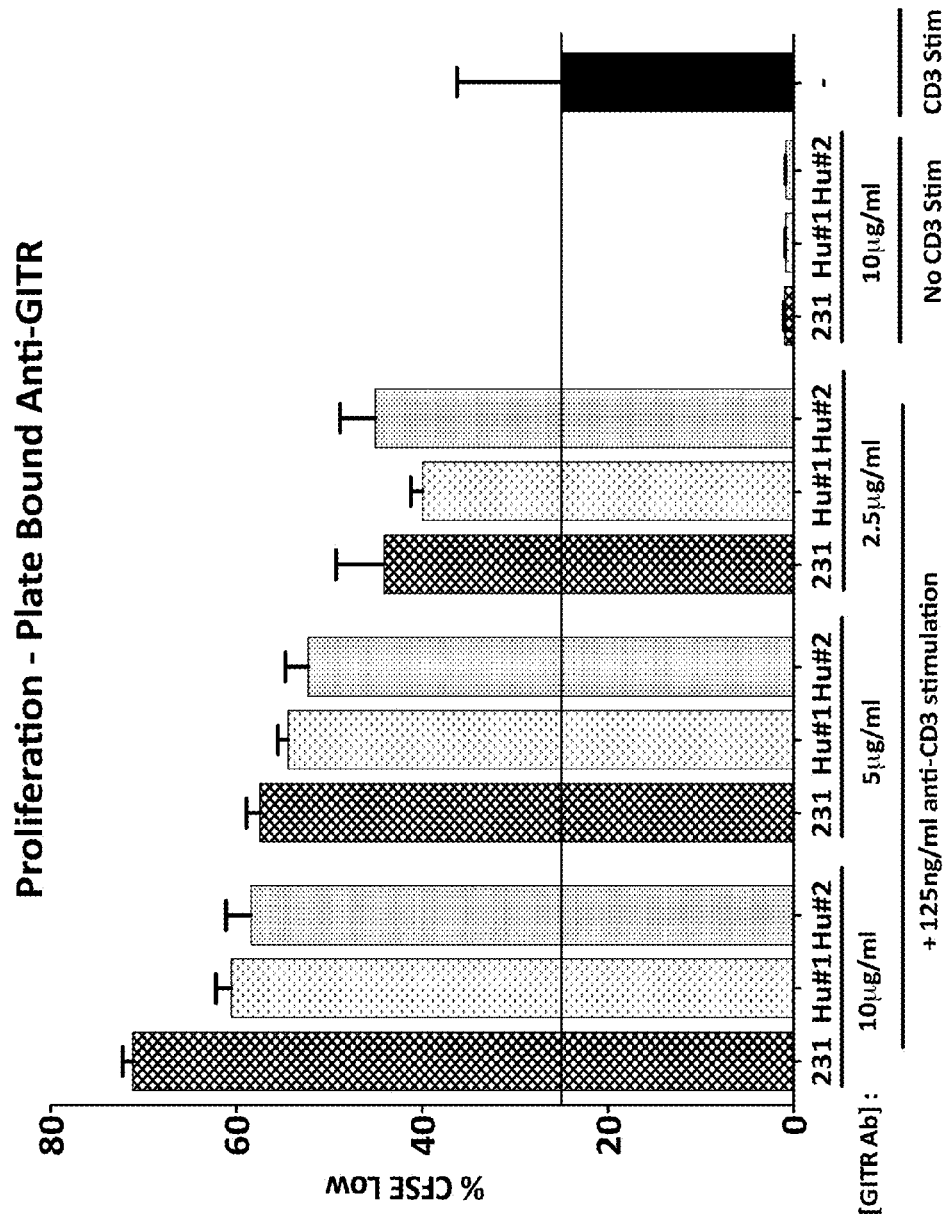

To evaluate the range of anti-GITR antibody concentrations that induces T-cell proliferation and cytokine production, enriched CD4+ T-cells were stimulated with 125 ng/ml anti-CD3/anti-CD28 and costimulated with titrated, plate bound chimeric parental 231-32-15, Hum231#1 or Hum231#2 anti-GITR antibodies. The result shown in FIG. 11 indicates that chimeric parental 231-32-15, Hum231#1 and Hum231#2 costimulation at a concentration of 10 µg/ml, 5 µg/ml or 2.5 µg/ml induces T cell proliferation as monitored by CFSE dilution. Moreover, in the absence of any anti-CD3/anti-CD28 stimulus, anti-GITR antibodies do not stimulate CD4+ T cell proliferation.

Figure 12A:
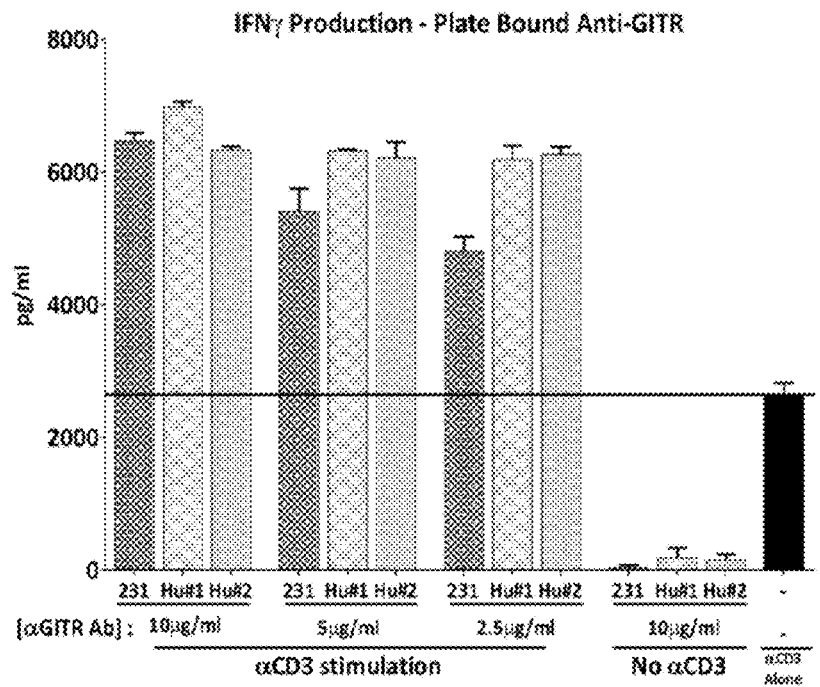

FIG. 12A shows that anti-CD3/anti-CD28 stimulation and costimulation with anti-GITR antibodies (chimeric parental 231-32-15, Hum231#1 or Hum231#2) over a range of concentrations (10 µg/ml, 5 µg/ml or 2.5 µg/ml) enhanced CD4+ T-cell production of IFNγ. Notably, in the absence of anti-CD3/anti-CD28 stimulation, anti-GITR antibodies (chimeric parental 231-32-15, Hum231#1 or Hum231#2) did not induce IFNγ production.

Figure 12B:
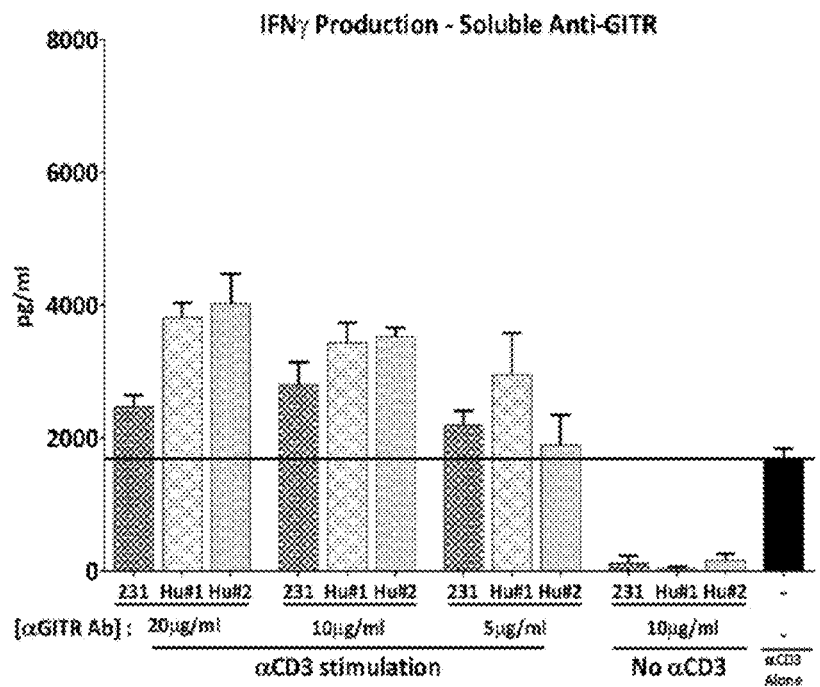

To examine further the functional activity of chimeric parental 231-32-15, Hum231#1 or Hum231#2 anti-GITR antibodies in solution, enriched CD4+ T cells were stimulated with 125 ng/ml anti-CD3/anti-CD28 and costimulated with titrated soluble anti-GITR antibodies. Soluble Hum231#1 or Hum231#2 anti-GITR antibodies also costimulated CD4+ T cells production of IFNγ, as shown in FIG. 12B.

6.3.4 Effect of Agonistic Anti-GITR Antibody on Anti-CD3 Induced PBMC Cytokine Production In this example, cytokine production induced by co-stimulation with the anti-GITR antibody Hum231#2 was examined using PBMCs. PBMCs isolated via ficoll gradient from healthy donor buffy coats (Research Blood Components, LLC) were stored in liquid nitrogen and thawed on the day of the experiment. The cells were resuspended in cell culture media (RPMI+10% FBS+20 U/ml of IL-2) and added to 96-well culture plates that contained plate-bound anti-CD3 antibody at various suboptimal concentrations (0.3-5 µg/ml) and 5 µg/ml of plate-bound anti-GITR anti-body or an isotype control IgG1 antibody. The samples were incubated for 4 days at 37° C. and 5% $CO_2$ and cell culture supernatants were collected on day 2 and day 4. The samples were tested using the V-PLEX Proinflammatory Panell (human) Kit (Meso Scale Discovery) to measure secreted cytokines (IFNγ, IL-2, TNFα, IL-10, IL-13 and IL-4) according to the manufacturer's instructions.

Figure 13:
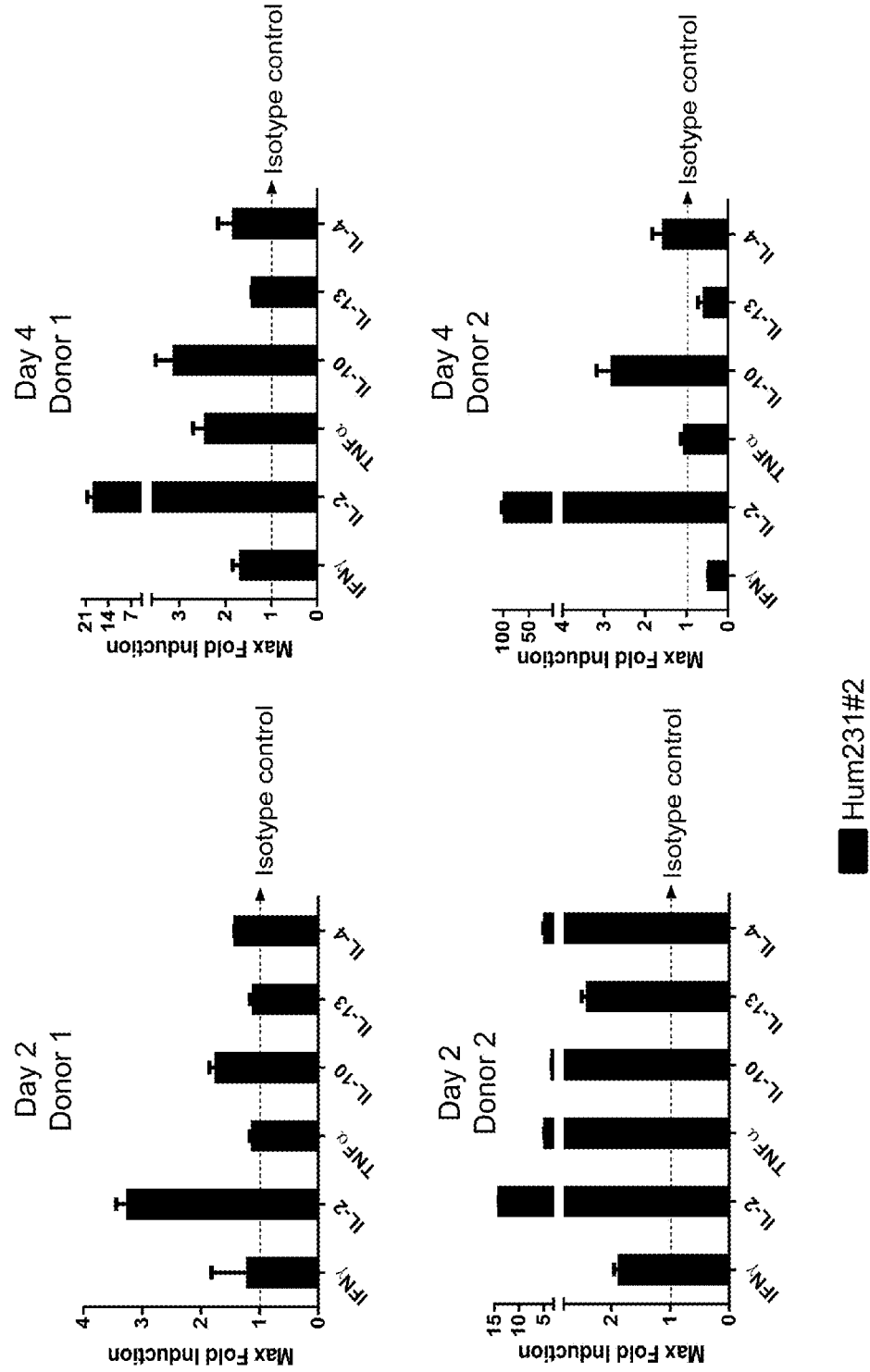

As depicted in FIG. 13, co-stimulation with the plate-bound anti-GITR antibody Hum231#2 induced secretion of multiple cytokines in PBMCs from two different donors.

6.3.5 Effect of Agonistic Anti-GITR Antibodies on Cytokine Production Measured by Intracellular Cytokine Staining The agonistic activity of Hum231#2 on cytokine production was further analyzed by intracellular cytokine staining PBMCs isolated via ficoll gradient from healthy donor buffy coats (Research Blood Components, LLC) were stored in liquid nitrogen and thawed on the day of the experiment. The cells were resuspended in cell culture media (RPMI+10% FBS+20 U/ml of IL-2) and added to 96-well culture plates that contained plate-bound anti-CD3 antibody at various suboptimal concentrations (0.3-5 µg/ml) and 5 µg/ml of plate-bound anti-GITR antibody or an isotype control IgG1 antibody. The samples were incubated for 3-4 days at 37° C. and 5% $CO_2$. After activation, to inhibit intracellular protein transport, the cells were treated with Brefeldin A (BD Biosciences) according to the manufacturer's instructions and the samples were incubated for 6 hours at 37° C. and 5% $CO_2$. After the incubation, the cells were stained with a FITC viability amine dye (Life technologies) to stain for dead cells. After washing with cold FACS buffer (1×PBS+2% FBS, pH7.2), an antibody cocktail containing antibodies against CD3 (APC Cy7, SP34.2), CD4 (PercP Cy5.5, L200) and CD8a (PE Cy7, SK1) diluted in cold FACS buffer was added to each sample and incubated for 10 minutes at 4° C. The cells were fixed and permeabilized with Cytofix-Cytoperm (BD Biosciences) for intracellular staining according to the manufacturer's instructions. The PBMCs were stained with antibodies against IFNγ (Alexa647, B27) and TNFα (PE, Mab11) and incubated at room temperature for 10 minutes. The samples were washed using 1×Perm-wash buffer (BD Biosciences) and acquired using a FACScanto flow cytometer (BD Biosciences). Flow cytometry plots were analyzed using Flojo software. The flow cytometry plots and graphs are representative of experiments using PBMCs from six different donors.

Figure 14A:
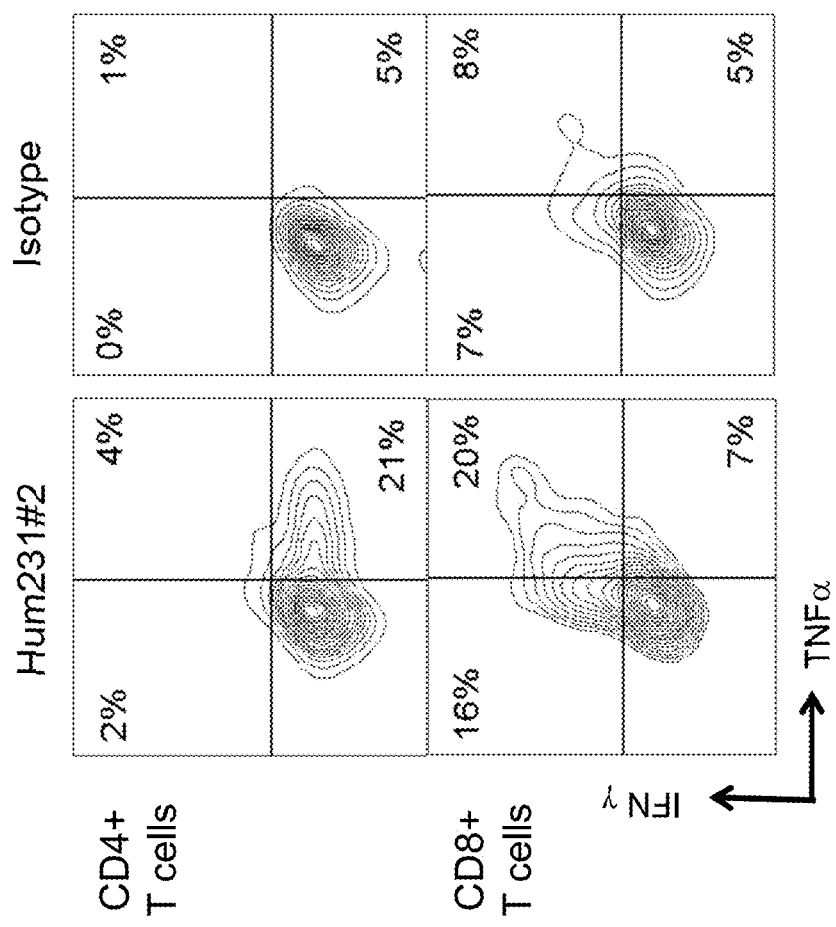
Figure 14B:
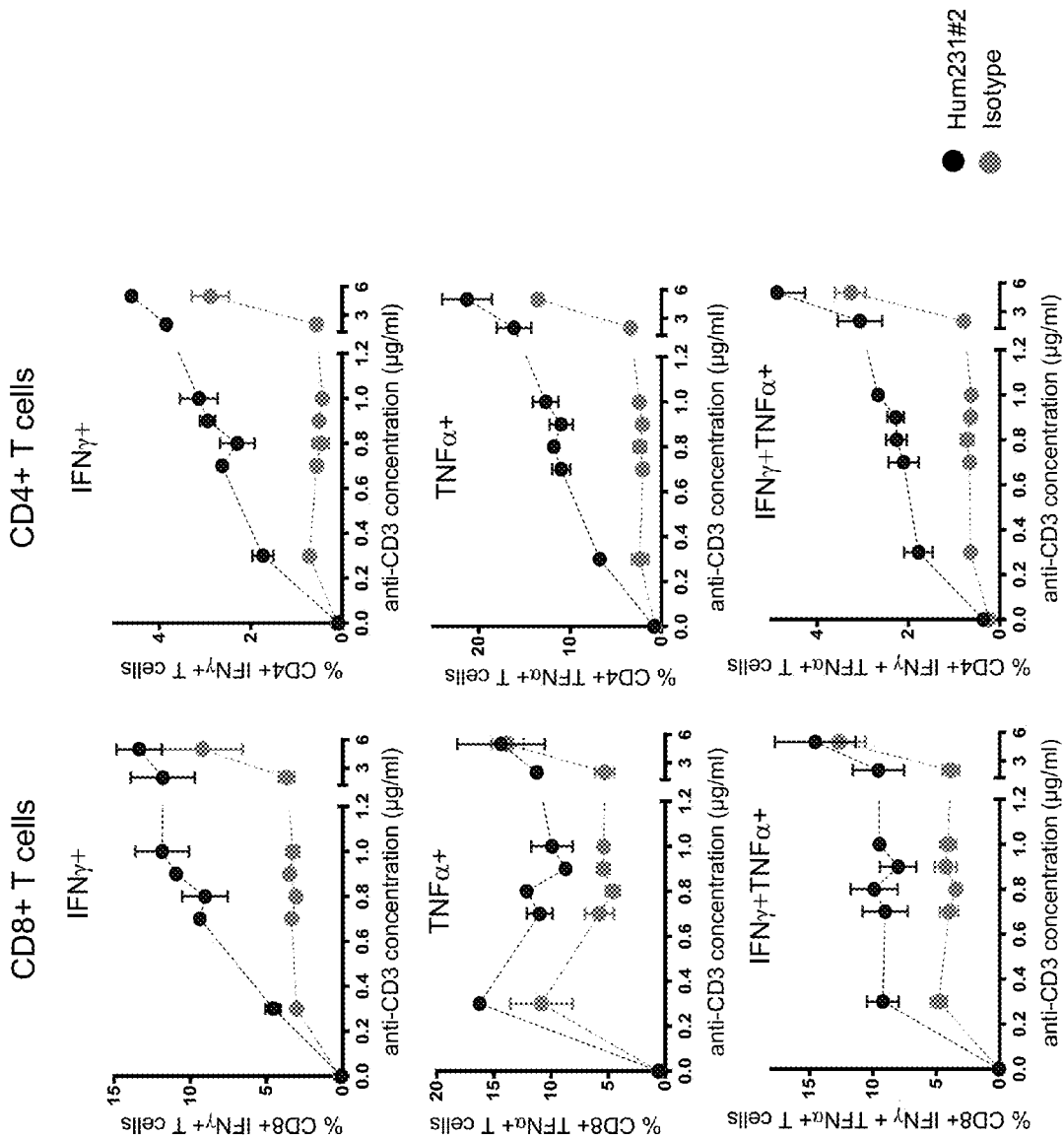

The GITR antibody Hum231#2 demonstrated co-stimulatory activity on human T cells, inducing IFNγ+ monofunctional T cells, TNFα+ monofunctional T cells as well as IFNγ+TNFα+ polyfunctional T cells over a range of suboptimal anti-CD3 antibody concentrations (FIGS. 14A and 14B).

Next, Hum231#2w, which is a human IgG1 antibody, was converted to a human IgG4 antibody named pab 1989. The antibody pab 1989 shares the same heavy chain variable region and the same light chain as Hum231#2w but comprises a human IgG4 constant region. The antibody pab1989 comprises a heavy chain sequence of SEQ ID NO: 554 and a light chain sequence of SEQ ID NO: 576.

Figure 14C:
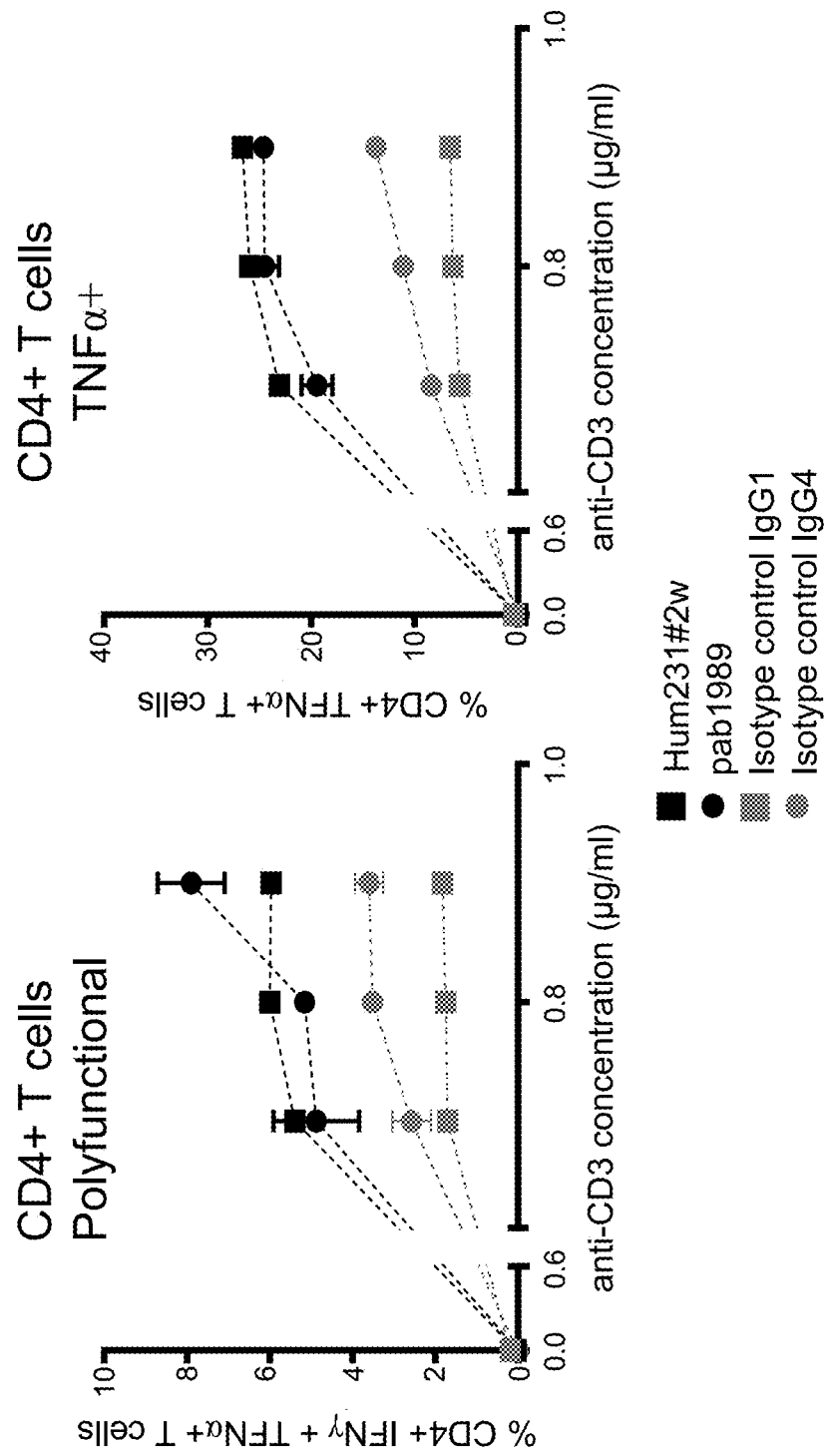

The IgG4 antibody pab1989 was tested in parallel with the IgG1 antibody Hum231#2w in the intracellular cytokine staining experiment described above. The anti-CD3 antibody was used at 0.7, 0.8 and 0.9 µg/ml and the anti-GITR antibodies at 5 µg/ml. The samples were incubated for 3-4 days at 37° C. and 5% $CO_2$. As shown in FIG. 14C, pab1989 exhibited similar agonistic activity as Hum231#2w, inducing IFNγ+TNFα+ polyfunctional CD4+ T cells and TNFα+ monofunctional CD4+ T cells. The graphs are representative of experiments using PBMCs from four different donors.

6.3.6 Effect of Cross-Linking on the Agonistic Activity of Anti-GITR Antibody

The effect of cross-linking on the functional activity of the anti-GITR antibody Hum231#2 was examined using anti-CD3 stimulated PBMCs.

Figure 15B:
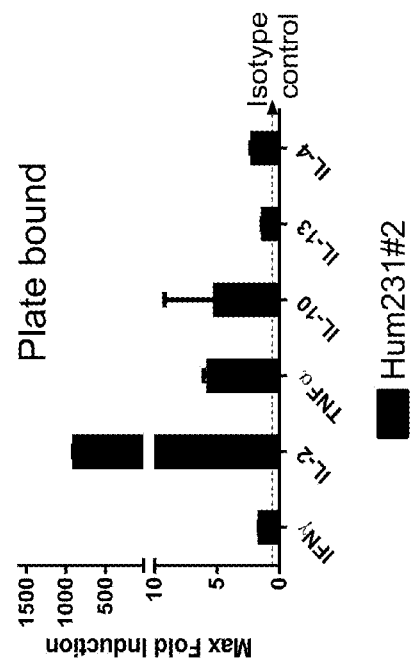
Figure 15C:
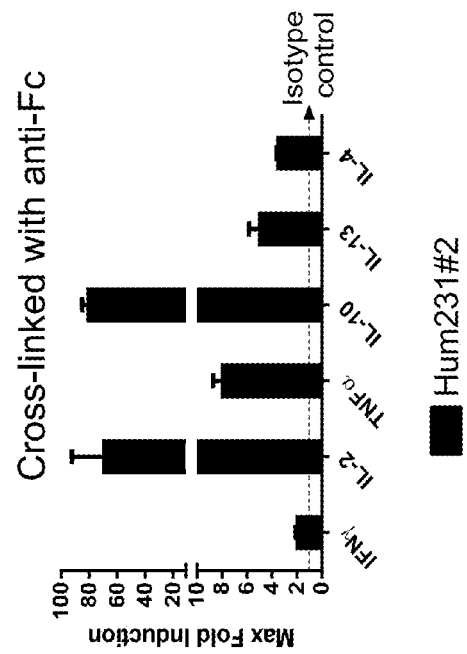
Figure 15A:
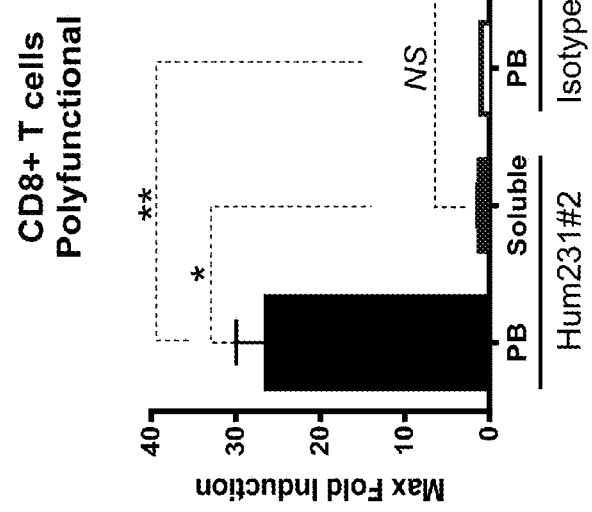

Plate-bound or soluble Hum231#2 was tested for the induction of IFNγ+TNFα+ polyfunctional T cells in a suboptimal CD3 stimulation assay as described in Section 6.3.5. As shown in FIG. 15A, only plate-bound, but not soluble, Hum231#2 increased the percentage of IFNγ+TNFα+ polyfunctional CD8+ T cells, as compared with the isotype control.

The PBMC cytokine secretion assay as described in Section 6.3.4 was repeated for plate-bound Hum231#2 or Hum231#2 cross-linked with an anti-Fc antibody. The culture supernatant was collected on day 4 for measuring secreted cytokines (IFNγ, IL-2, TNFα, IL-10, IL-13 and IL-4). Co-stimulation with plate-bound (FIG. 15B) or anti-Fc cross-linked (FIG. 15C) Hum231#2 induced cytokine secretion.

6.3.7 Activity of Humanized 231-32-15 Clones on Buffy Coat 8 (BC8) and Measurement of Effector T-Cells or T Regulatory Cells In this example, the effects of agonistic anti-GITR antibodies on CD4+ T effector or CD4+ T regulatory cells were measured by monitoring their proliferation. Enriched CD4+ T-cells were labeled with CFSE and were stimulated with 125 ng/ml plate bound anti-CD3 antibody. Proliferated enriched CD4+ T-cells were monitored by CFSE dilution after 5 days in culture.

Figure 16A:
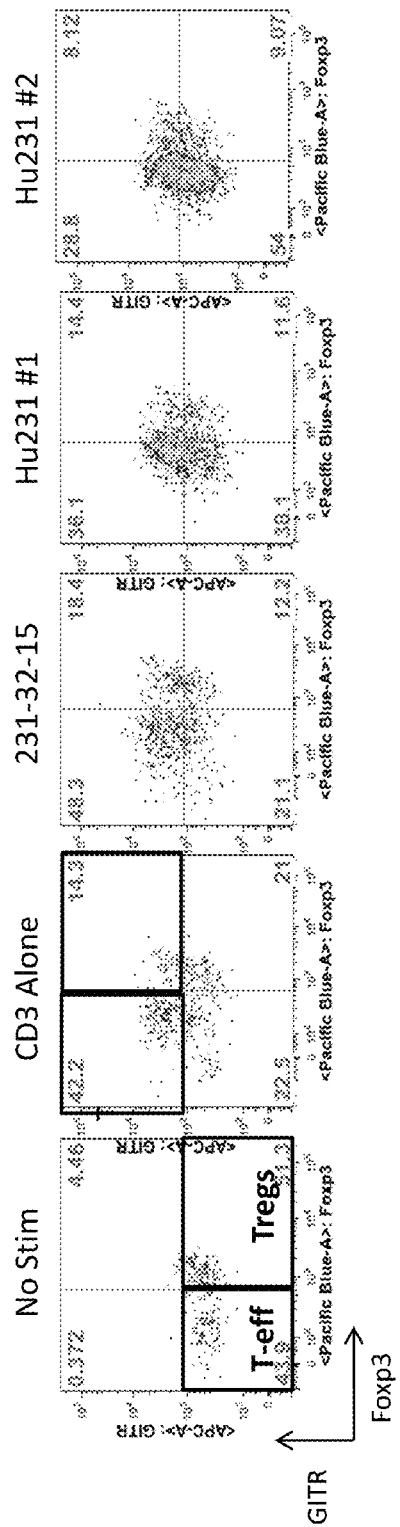
Figure 16B:
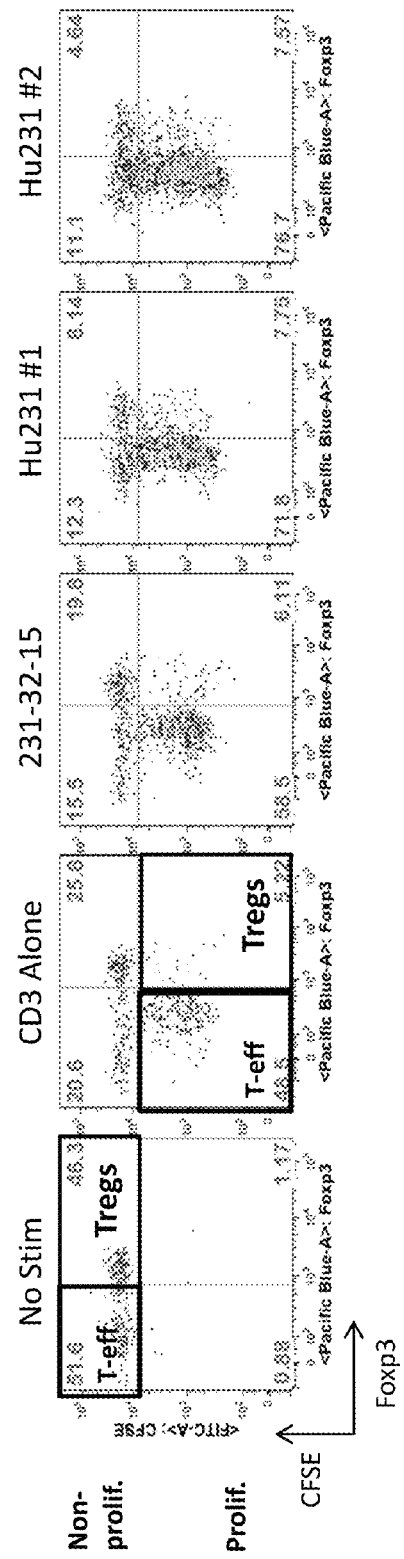

The CD4+ T effector or T regulatory cell population within the enriched CD4+ T cells population shown in FIGS. 16A and 16B was identified by flow cytometry staining by their cell surface markers. Activated CD4+ T effector cells were characterized as $CD25^+$, $CD45RA^-$, $CD127^{Med/Low}$ and $Foxp3^{Neg/Low}$. CD4+ T regulatory cells were identified as $CD4^+$, $CD25^+$, $CD45RA^-$, $CD127^{Low}$, and $Foxp3^{High}$. FACS staining was performed according to Table 14 below:

TABLE 14

FACS staining panel

| Channel | Laser | Standard Flurochrome | Antigen/Fluorochrome |
| --- | --- | --- | --- |
| 1 | Blue 488 nm | FITC, AF488, GFP | CFSE |
| 2 | Blue 488 nm | PE | CD127 |
| 6 | Blue 488 nm | Pe-Cy7 | CD45RA |
| 7 | Red 633 nm | APC | GITR APC |
| 9 | Red 633 nm | APC-Cy-7, APC-H7 | CD25-APC-H7 |
| 10 | Violet 405 nm | DAPI, Pac Blue, V450 | FoxP3 e450 |
| 11 | Violet 405 nm | AF430, AmCyan, V500 | L/D |

Results of the stimulation assay are shown in the FACS plots of FIGS. 16A and 16B. Gating on CD4+ Tregs ($CD4^+$ $CD25^+$, $CD45RA^-$. $CD127^{Low}$ and $Foxp3^{High}$) or activated CD4+ T effector cells ($CD25^+$, $CD45RA^-$, $CD127^{Med/Low}$ and $Foxp3^{Neg/Low}$) shows that 125 ng/ml anti-CD3/anti-CD28 stimulation alone and in conjunction with anti-GITR costimulation upregulated GITR expression on both T effector and T regulatory cells.

FIG. 16A depicts FACS analysis of both T-effector and T-regulatory cells. Both cell types expressed GITR on their cell surface following stimulation with anti-CD3 alone or in conjunction with anti-GITR antibodies. However, co-stimulation with anti-GITR antibodies preferentially expands T-effector cells over T-regulatory cells, leading to an increased Teff/Treg ratio (FIG. 16B).

As further evidence for the agonistic activity of anti-GITR antibodies on T-cells in the context of cellular immunity, T cell responses following stimulation of PBMCs were evaluated.

Figure 17A:
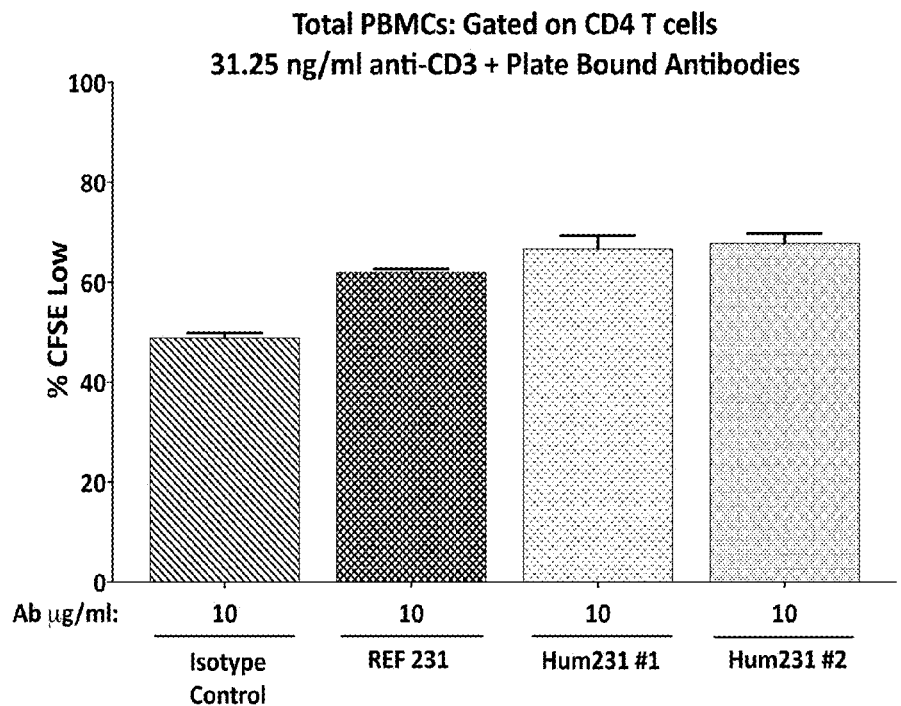
Figure 17B:
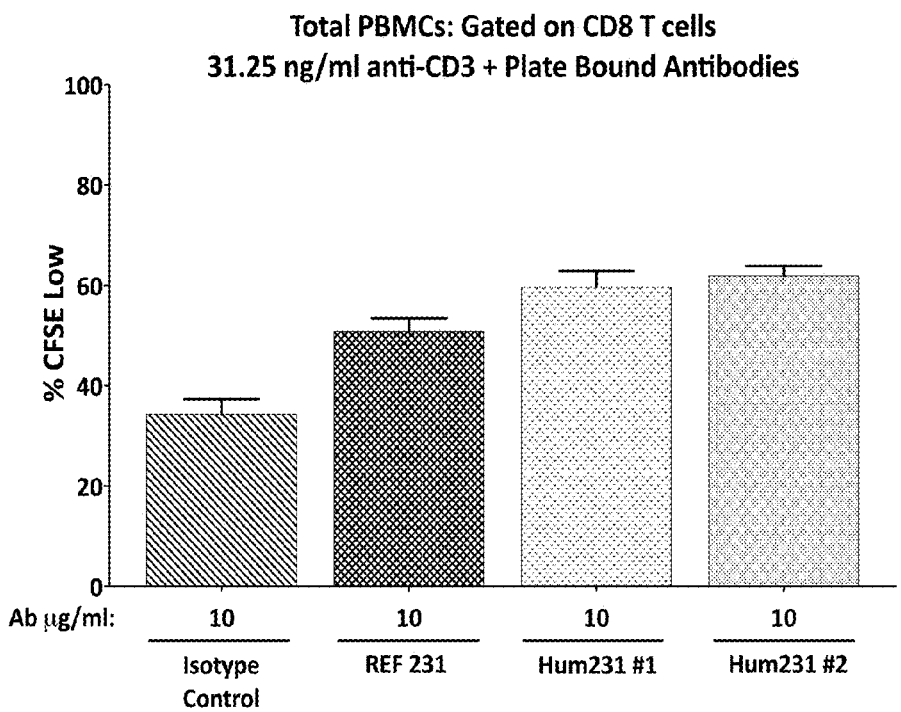

Stimulation of PBMC was titrated by adjusting anti-CD3-induced proliferation on PBMCs. Illustrated in FIGS. 17A and 17B are CFSE-labeled PBMCs stimulated with 31.25 ng/ml of plate bound anti-CD3/anti-CD28 in conjunction with either plate bound anti-GITR antibodies or isotype control. As a positive control for the activity of anti-GITR antibodies, the same stimulation condition was used to stimulate enriched CD4+ T cells (data not shown).

CD4+ or CD8+ T-cells in the PBMC population were identified by their staining with anti-CD3 and anti-CD4+ or anti-CD3 and anti-CD8. FloJo (Tree Star, Inc.) analysis of acquired FACS samples gated on CD4+CD3 T cells or CD8'CD3 T cells showed anti-GITR chimeric parental 231-32-15 (REF 231), Hum231#1 and Hum231#2 antibodies stimulated T cell proliferation (% CFSE low). In particular, the experiment depicted in FIG. 17B revealed that anti-GITR chimeric parental 231-32-15 (REF 231), Hum231#1 and Hum231#2 antibodies have activity on CD8 T cells.

6.3.8 Effect of Agonistic Anti-GITR Antibodies on GITR NF-κB-Luciferase Reporter Cell Line A human GITR NF-κB-luciferase reporter cell line (Promega) was designed to probe the co-stimulatory activity of anti-GITR agonistic antibodies. Activation of GITR by anti-GITR agonistic antibody or GITR ligand has been reported to activate NF-κB (Snell L M et al., (2010) J Immunol 185: 7223-7234; Bulliard Y et al., (2013) J Exp Med 210: 1685-1693; Yu K Y et al., (2003) Biochem Biophys Res Commun 310: 433-438). As such, Jurkat cells were genetically modified to stably express the GloResponse NF-κB-luc2P construct and human GITR. The reporter cells were resuspended in assay media (RPMI+1% FBS) and incubated with various concentrations (12.5, 10, 5, 2.5, 1.25, and 0.625 μg/ml) of plate-bound anti-GITR antibodies Hum231#2w, m6C8 or an IgG1 isotype control in the absence or presence of 0.3 μg/ml of a plate-bound anti-CD3 antibody (Clone SP34). The plates incubated with the anti-CD3 antibody were read after 6 or 18 hours of incubation. The plates without the anti-CD3 antibody were read after 2, 5, 6, 8 or 18 hours of incubation. After incubation, the plates were equilibrated at room temperature and then an equal volume of room temperature Bio-Glo reagent (Promega) was added. Luminescence was read using an EnVision multilabel reader 2100.

Figure 18A:
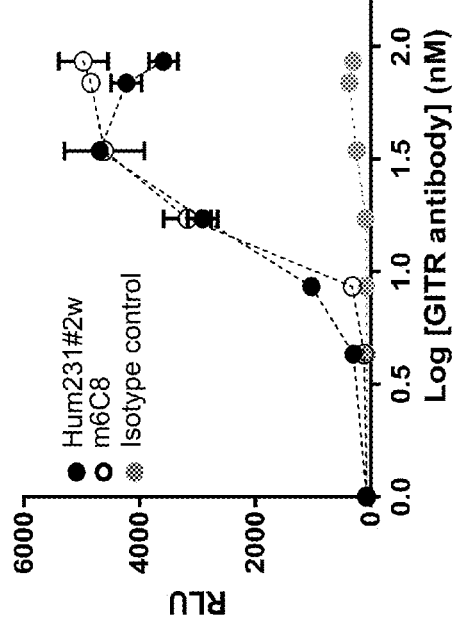
Figure 18C:
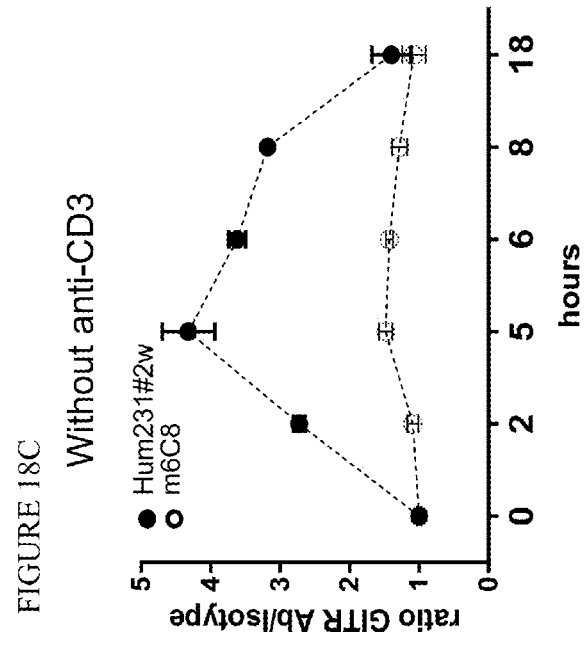
Figure 18B:
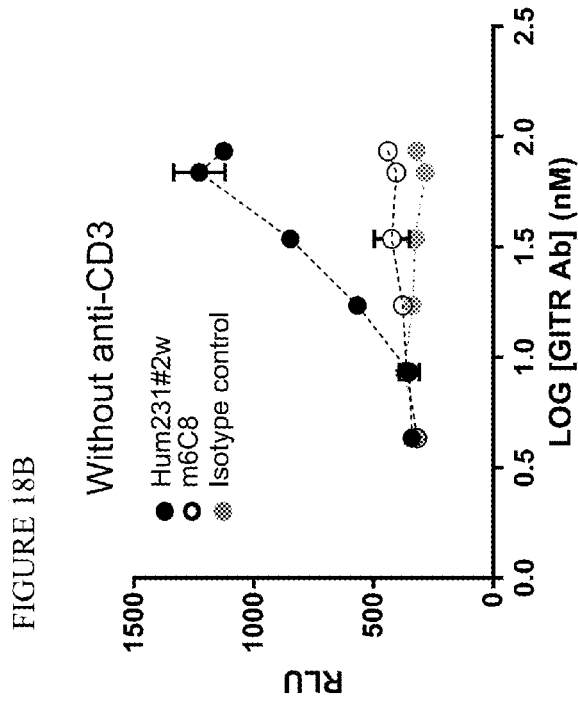

For the assay with the anti-CD3 antibody, the luciferase RLU at 18-hour post-stimulation was plotted for each antibody concentration tested (FIG. 18A). Similarly, for the assay without the anti-CD3 antibody, FIG. 18B is a graph showing the luciferase relative light units (RLU) at 5-hour post-stimulation for various antibody concentrations tested. In FIG. 18C, the highest ratios of luciferase expression (GITR Ab/isotype control) without the anti-CD3 antibody, among several antibody concentrations tested, at 0, 2, 5, 6, 8 and 18 hours post-stimulation are shown. The data shown are representative of four experiments with the anti-CD3 antibody or two experiments without the anti-CD3 antibody.

In the presence of the anti-CD3 antibody, although m6C8 showed stronger agonistic activity at 6 hour (data not shown), by 18-hour post-stimulation, Hum231#2w and m6C8 induced similar activation of the GITR reporter cell line (FIG. 18A). However, in the absence of the anti-CD3 antibody, only Hum231#2w but not m6C8 induced activation of the GITR reporter cell line (FIG. 18B).

6.3.9 Effect of Agonistic Anti-GITR Antibody on Fc Gamma Receptor IIIA (CD16) Reporter Cell Line In this example, expression of human GITR by activated nTreg cells and T effector cells was examined. PBMCs isolated from healthy donors were enriched for CD3+ T cells (Teff) or CD4+CD25+CD45RA+ T cells (nTregs) using magnetic-based separation techniques. T lymphocytes were then activated with CD3-CD28 expansion beads with 500U rIL-2 for 4 days, and 50U rIL-2 for an additional 5 days. GITR receptor quantitation was determined by flow cytometry by gating on CD4+ and CD8+ Teff versus nTreg. Quantibrite beads (BD Biosciences) were run simultaneously and used to quantify GITR receptor surface density.

Figure 19B:
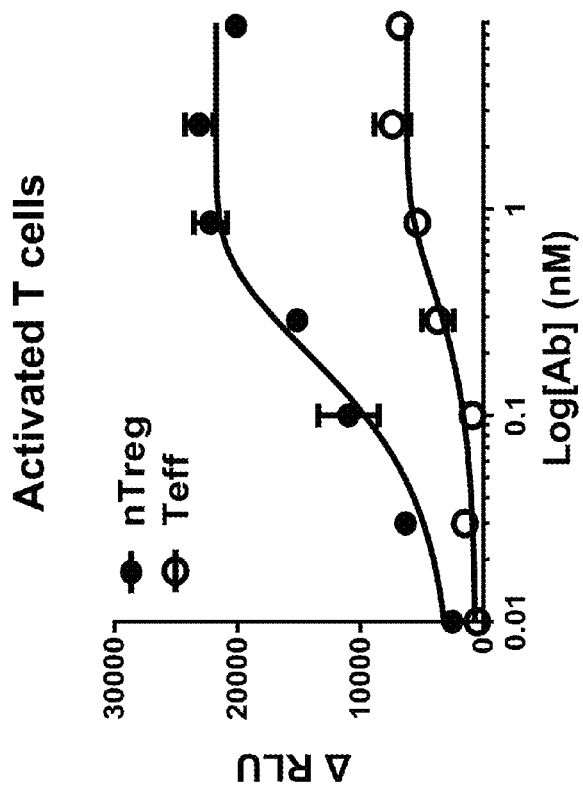
Figure 19A:
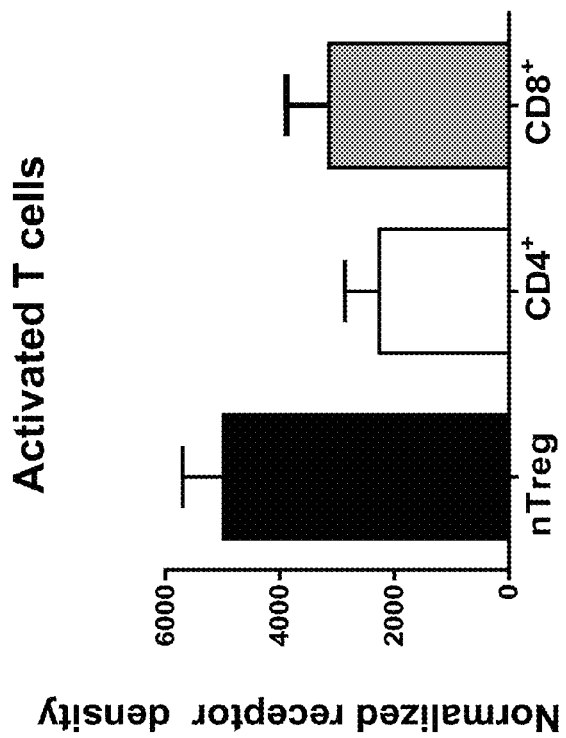

As shown in FIG. 19A, the surface expression of human GITR on activated nTreg cells at day 9 (and all time points evaluated) was higher than that on activated CD4+ or CD8+ T effector cells.

Next, the ability of anti-GITR antibody Hum231#2w to co-engage GITR and signal via activating Fc gamma receptors was evaluated using a reporter cell line expressing Fc gamma receptor IIIA (CD16) together with activated T effector (Teff) or nTreg cells, generated as described. Expanded Teff or nTreg cells were incubated with different doses of Hum231#2w or an IgG1 isotype control. Jurkat NFAT-luciferase reporter cells overexpressing CD16 (158 V/V polymorphism) were added to the samples. Binding of the antibody/antigen complex, wherein the antigen is located on the cell surface, to CD16 signals to the promoter/reporter construct and results in luciferase gene transcription. Plates were incubated for 20 hours at 37° C. and 5% $CO_2$. After this incubation, Bio-Glo Luciferase Assay Reagent (Promega) was thawed at room temperature and 75 µl was added to each well of the 96-well white assay plates. Within 5-10 minutes, luminescence was measured. Background luminescence was subtracted from each sample reading and the adjusted relative light units (RLU) were recorded. Δ RLU represents the RLU of the anti-GITR antibody minus that of the isotype control.

Consistent with the differential surface GITR expression between activated nTregs and activated CD4+ or CD8+ T effector cells (FIG. 19A), the anti-GITR antibody Hum231#2w preferentially activated CD16 when bound to activated nTreg cells (FIG. 19B).

Figure 19C:
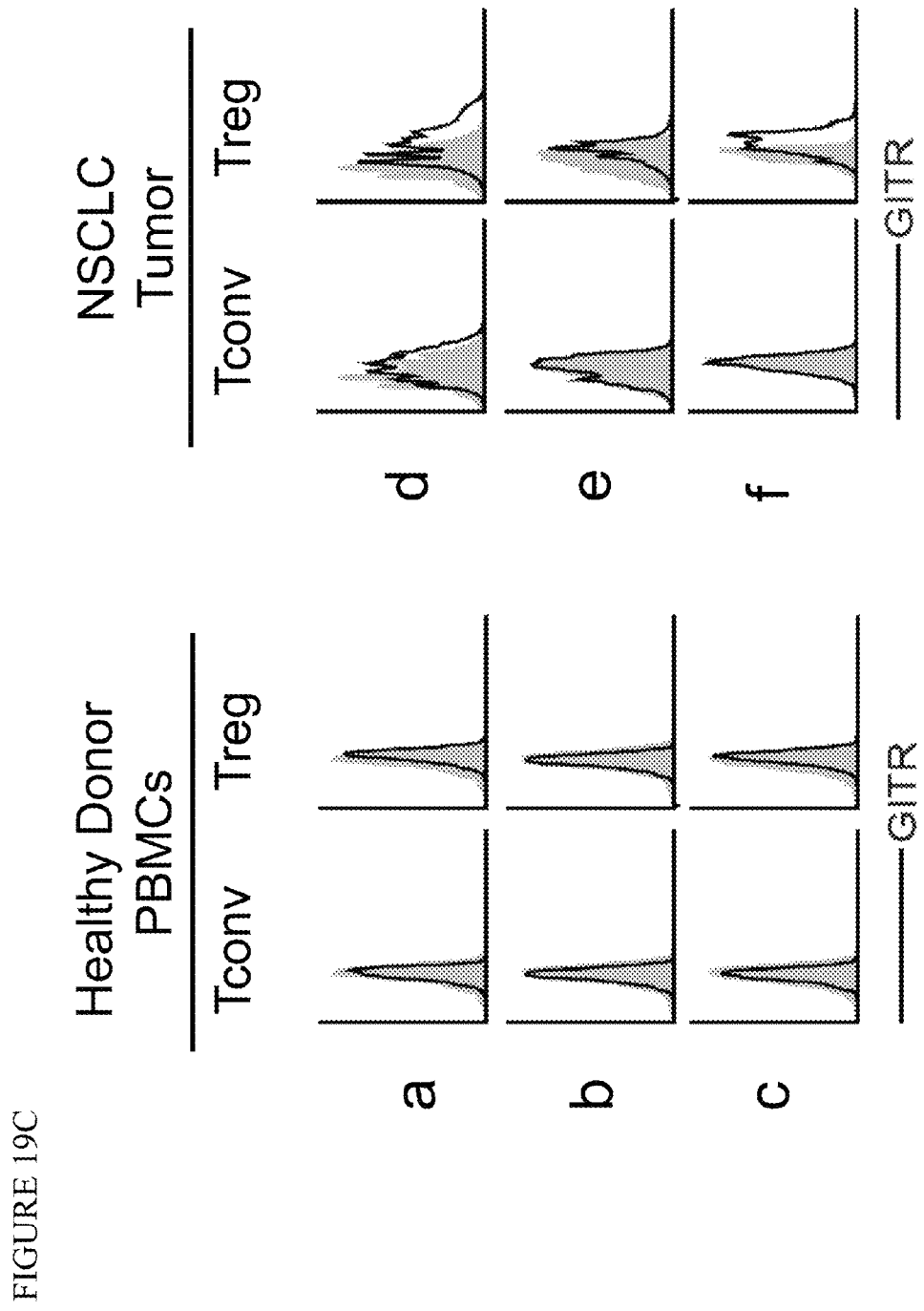

To evaluate if GITR overexpression was a feature of regulatory T cells located within tumor microenvironment, GITR expression was compared on T cells isolated from the blood of healthy human donors (FIG. 19C, a-c, n=3) or from tumor tissues of non-small cell lung cancer (NSCLC) patients (FIG. 19C, d-f, n=3). To eliminate background binding of antibodies to immune populations, all the cells were incubated with purified CD16/32 antibody (10 µg/ml, 20 minutes at room temperature) prior to the addition of cell-surface and intracellular antibodies. Following FcR-blockade, all the samples were incubated with APC-conjugated anti-GITR antibody (clone 110416, R&D systems) or isotype control and a cell-surface antibody lineage-cocktail (CD3-FITC, CD25-PECy7, CD4-BV650 and CD8a-PE) for 45 minutes on ice (1 µg/ml each), washed three times with FACS buffer (PBS, EDTA and 0.5% BSA), followed by fixation/permeabilization and incubation with Pacific Blue-conjugated FOXP3 (fix/perm and incubation each 45 minutes on ice, 1 µg/ml). The stained samples were then analyzed using a LSRFortessa flow cytometer (BD Biosciences). The cell populations in FIG. 19C were defined as: Tconv (CD3+, CD4+, CD8a−, CD25low, FOXP3−) or Treg (CD3+, CD4+, CD8a−, CD25high, FOXP3+).

As demonstrated in FIG. 19C, GITR surface expression was highest on regulatory T cells isolated from the tumor tissues of NSCLC patients, with little or no detectable level on Treg or conventional T cells from healthy donors.

6.3.10 Effect of Agonistic Anti-GITR Antibody on the Cytokine Production of T Cells from African Green Monkey To test for species cross-reactivity, Hum231#2 was evaluated for its binding to GITR from African green monkey (AGM). Briefly, AGM PBMCs (Worldwide Primates) were thawed and counted. The PBMCs were resuspended in cell culture media (RPMI+10% FBS) and stimulated with an anti-CD3 antibody (clone SP34.2, BD) or ConA (Sigma) plus IL-2 (20 U/ml) for 3 days at 37° C. and 5% CO2. Following activation, the cells were stained with amine dye FITC (Life technologies) for 15 minutes at room temperature. The cells were washed with cold FACS buffer (1×PBS+ 2% FBS, pH7.2) and an antibody cocktail diluted in cold FACS buffer containing antibodies against CD3 (APC Cy7, SP34.2), CD4 (PercP, L200), CD8 (PE Cy7, SK1) and PD-1 (PE, EH12.2H7) was added and incubated for 10 minutes at 4° C. The cells were washed and incubated with 2.5 µg per well of Hum231#2 or IgG1 isotype control for 10 minutes at 4° C. The cells were washed and then stained with a secondary anti-Fc F(ab')$_2$ antibody conjugated with Alexa647 for 10 minutes at 4° C. The cells were washed and fixed with 1.6% paraformaldehyde before acquisition using a FACSCanto flow cytometer (BD Biosciences). FACS files were analyzed using FACS DIVA software.

Figure 20A:
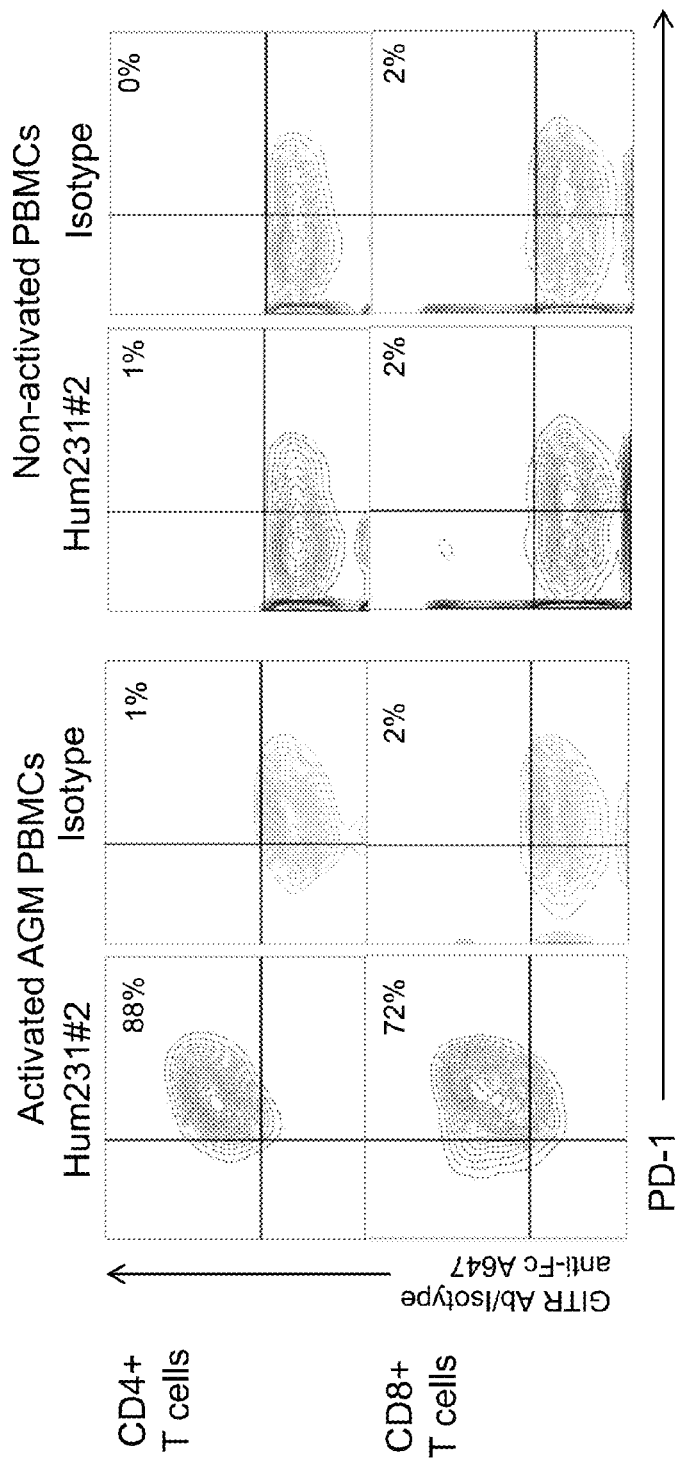

As shown in FIG. 20A, the anti-GITR antibody Hum231#2 binds to activated AGM CD4+ and CD8+ T cells. Unstimulated T cells from AGM do not express baseline levels of GITR and the GITR levels on the cell surface are up-regulated upon T cell activation. The plots shown in FIG. 20A are representative of experiments using PBMCs from three different AGMs.

Next, a CD3 substimulation assay was performed using PBMCs from African green monkey (AGM) to examine the agonistic activity of Hum231#2w. Human (Research Blood Components, LLC) or AGM PBMCs (Worldwide Primates) were isolated via ficoll gradient from healthy donors and were stored in liquid nitrogen and thawed on the day of the experiment. The cells were resuspended in cell culture media (RPMI+10% FBS+20 U/ml of IL-2) and added to 96-well culture plates that contained plate-bound anti-CD3 antibody (0.8 µg/ml) and various concentrations (2, 4, 5, 6 and 9 µg/ml) of plate-bound anti-GITR antibody or an isotype control IgG1 antibody. The samples were incubated for 4 days at 37° C. and 5% $CO_2$. After activation, to inhibit intracellular protein transport, the cells were treated with Brefeldin A (BD Biosciences) according to the manufacturer's instructions and the samples were incubated for 6 hours at 37° C. and 5% $CO_2$. After the incubation, the cells were stained with a FITC viability amine dye (Life technologies) to stain for dead cells. After washing with cold FACS buffer (1×PBS+2% FBS, pH7.2), an antibody cocktail containing antibodies against CD3 (APC Cy7, SP34.2), CD4 (PercP Cy5.5, L200) and CD8a (PE Cy7, SK1) diluted in cold FACS buffer was added to each sample and incubated for 10 minutes at 4° C. The cells were fixed and permeabilized with Cytofix-Cytoperm (BD Biosciences) for intracellular staining according to the manufacturer's instructions. The PBMCs were stained with antibodies against IFNγ (Alexa647, B27) and TNFα(PE, Mab11, only for human PBMCs) and incubated at room temperature for 10 minutes. Samples were washed using 1× Perm-wash buffer (BD Biosciences) and acquired using a FACScanto flow cytometer (BD Biosciences). Flow cytometry plots were analyzed using Flojo software.

Figure 20B:
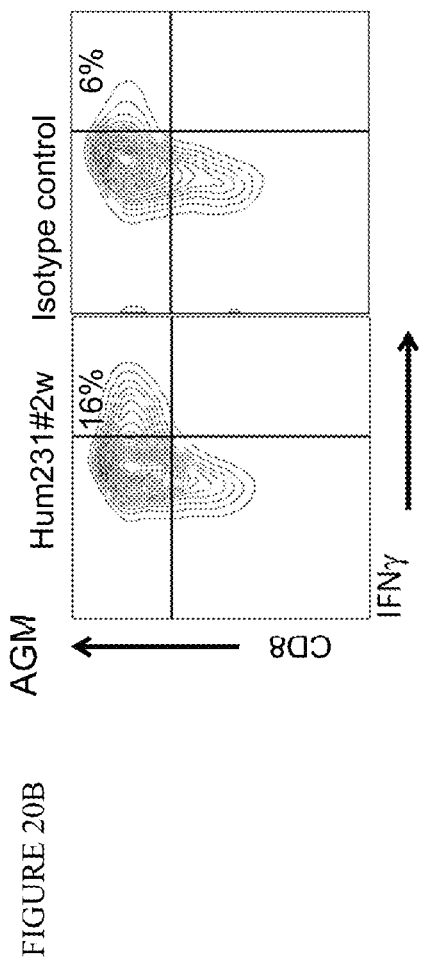
Figure 20C:
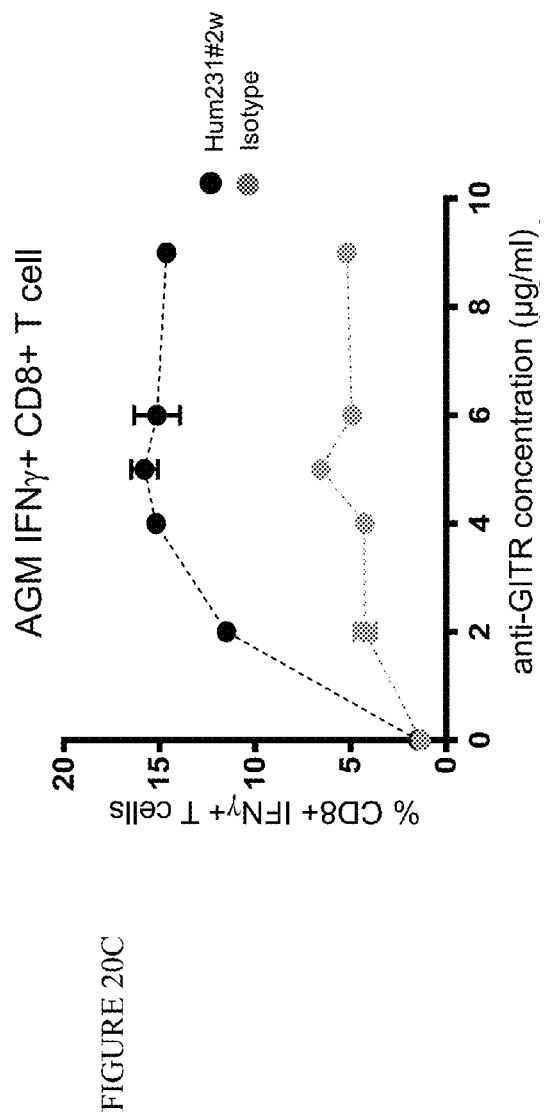

As shown in FIGS. 20B and 20C, co-stimulation with the anti-GITR antibody Hum231#2w induces IFNγ production by CD8+AGM T cells. The flow cytometry plots and graphs are representative of experiments using PBMCs from two AGMs.

6.3.11 Effect of the Simultaneous Binding of Recombinant Human GITR Ligand and Humanized 231-32-15 Clones on Anti-CD3 Stimulated CD4+ T Cells An agonistic anti-GITR antibody which does not prevent GITR binding to GITR ligand (GITRL) may result in an enhanced immune response, characterized by enhancing the proliferation and/or the effector function of T effector cells and/or down-regulating the suppressive function of T regulatory cells.

Anti-GITR antibodies, either alone or in combination with recombinant human GITRL, are tested for their agonistic activity on CD4+ T cells. Enriched CD4+ T cells are labeled with 1-2 μM CFSE, washed and then stimulated with plate bound anti-CD3 (125 ng/ml), soluble anti-CD28 (125 ng/ml) and 10 U IL-2, together with 10 μg/ml chimeric parental 231-32-15 antibody, 10 μg/ml Hum231#1, 10 μg/ml Hum231#2, 10 μg/ml GITRL, a combination of 10 μg/ml chimeric parental 231-32-15 antibody with 10 μg/ml GITRL, a combination of 10 μg/ml Hum231#1 with 10 μg/m1GITRL, or a combination of 10 μg/m1Hum231#2 with 10 μg/ml GITRL, at 37° C. for 3 to 6 days. The culture supernatants and cells are then collected from the plates. Cell proliferation and cytokine release are examined as described in Sections 6.3.1 and 6.3.2, respectively. The effects of the simultaneous binding of anti-GITR antibodies and GITRL on CD4+ T effector cells or CD4+ T regulatory cells can be further tested as described in Section 6.3.7. This study may show a synergistic or additive effect between GITRL and anti-GITR antibodies (chimeric parental 231-32-15, Hum231#1 and Hum231#2) in enhancing immune responses.

As an alternative to using soluble recombinant human GITRL for testing co-agonist activity in combination with the anti-GITR antibodies described herein, it is also possible to use antigen-presenting cells that are induced to express GITRL. Such induced APCs may be cultured with CD4+ T effector cells or CD4+ T regulatory cells, as described above, in the presence or absence of the anti-GITR antibodies and the function of the T cells assessed. To induce GITRL expression, antigen presenting cells such as macrophage or dendritic cells are incubated with a TLR4 ligand (e.g., LPS) for 1, 2, 4, 6 or 12 hours as described, e.g., in Tone M et al., (2003) PNAS 100: 15059-15064; or with whole β-glycan particles (WGP) purified from the cell wall of *Saccharomyces cerevisiae* for 6, 12, 24, 48 or 72 hours, as described, e.g., in Tian J et al., (2012) PLoS One, 7(10): e46936.

6.3.12 Effect of Agonistic Anti-GITR Antibody on OX40 and PD-1 Surface Expression on T Cells In this example, the agonistic anti-GITR antibody was evaluated for its impact on the surface expression of OX40 and PD-1 on T cells. PBMCs isolated via ficoll gradient from healthy donor buffy coats (Research Blood Components, LLC) were stored in liquid nitrogen and thawed on the day of the experiment. The cells were resuspended in cell culture media (RPMI+10% FBS+20 U/ml of IL-2) and added to 96-well culture plates that contained plate-bound anti-CD3 antibody (clone SP34) at various suboptimal concentrations (0, 0.7, 0.8 and 0.9 μg/m1) and 5 μg/ml of the plate-bound anti-GITR antibody Hum231#2 or an isotype control IgG1 antibody. The samples were incubated for 4 days at 37° C. and 5% CO$_2$. After the incubation, the cells were stained with a FITC viability amine dye (Life technologies) to stain for dead cells. After washing with cold FACS buffer (1×PBS+2% FBS, pH7.2), an anti-OX40 antibody was added and incubated for 10 minutes at 4° C. The cells were washed and an anti-human Fc F(ab')$_2$ Alexa647 was added and incubated for 10 minutes at 4° C. After centrifugation and a washing step, an antibody cocktail containing antibodies against CD3 (APC Cy7, SP34.2), CD4+ (PercP Cy5.5, L200), CD8a (PE Cy7, SK1) and PD-1 (PE, EH12.2H7) diluted in cold FACS buffer was added to each sample and incubated for 10 minutes at 4° C. The samples were washed and resuspended in 200 μl of 1.6% paraformaldehyde before acquisition using a FACScanto flow cytometer (BD Biosciences). FACS plots were analyzed using Flojo software. The flow cytometry plots and graphs are representative of experiments using PBMCs from one donor.

Figure 21A:
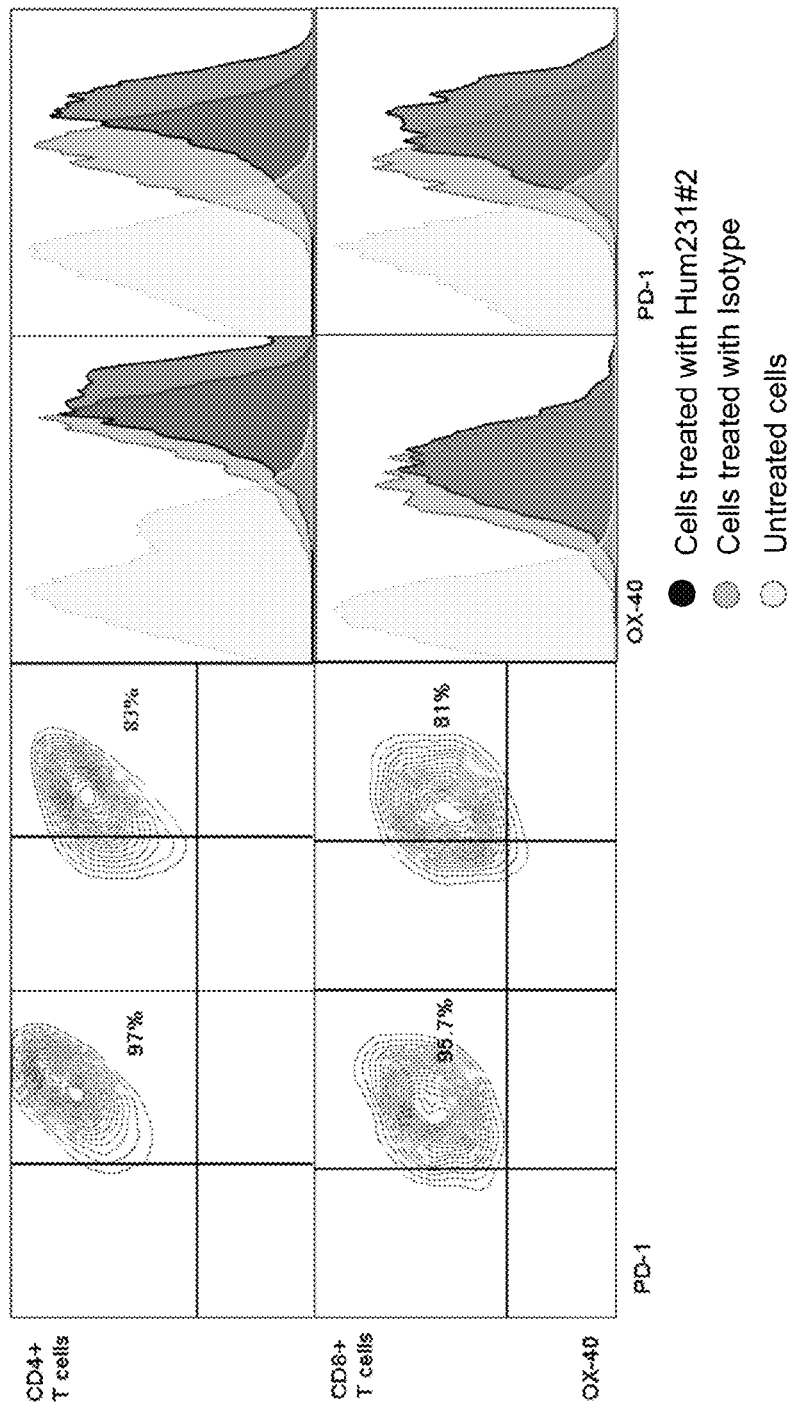
Figure 21B:
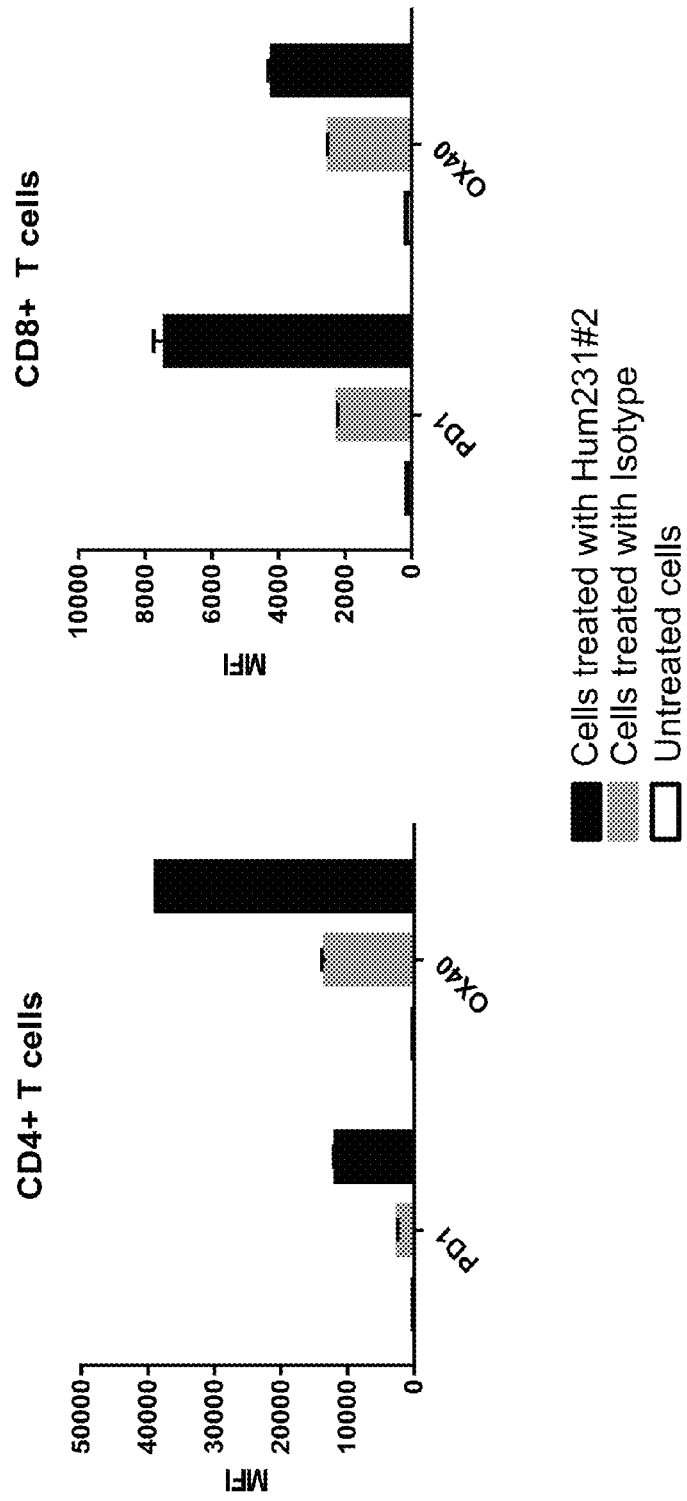

As shown in FIG. 21, co-stimulation with the anti-GITR antibody Hum231#2 increases OX40 and PD-1 surface expression on human CD4+ and CD8+ T cells.

6.4 Example 4: Germlining of Humanized Variant

This example describes the generation of germline, humanized variants.

6.4.1 Library Design

A library approach was used to generate humanized variants with an increased human germline content by introducing site directed mutations via degenerate codons into heavy and light chain variable regions. The variable region of the VH chain was mutated by replacing 17 amino acids positions with 2 to 4 amino acids, resulting in a final diversity of 1.3E+06. The variable region of light chain was mutated at 9 amino acid positions (2-3 amino acids per position), resulting in a final diversity of 7.7E+02. The different framework and CDR positions included in the library are shown in FIG. 22. The libraries were designed using IGHV1-2*02 VH human germline (FIG. 22A) and IGKV4-1*01 VL human germline (FIG. 22B).

6.4.2 Library Generation

The mutated humanized variable regions were cloned into retroviral expression vectors (pCMA). These constructs were subsequently used to transduce preB cells and express antibodies on the surface using Retrocyte Display® technology. The retroviral expression vector contained MSCV based 5' and 3' LTR's, immunoglobulin constant region (IGHG1 or IGKC) comprising membrane anchor fraction (IGHG1) and a CD4 surface marker gene. The surface marker and immunoglobulin are coupled by IRES (internal ribosome entry site). The term "variable region" in this example means VDJ rearranged genes for the heavy chain and VJ rearranged genes for the light chains.

6.4.2.1 Generation of a Humanized Heavy Chain Library

Synthesised humanized variable heavy chain regions (Eurofins MWG GmbH) were cloned into the retro-viral expression vector containing immunoglobulin constant region (IGHG1) comprising membrane anchor fraction. Digestion and ligation were performed in one step and one tube using the typeIIS restriction enzyme LguI and T4-DNA Ligase at 37° C. for 1 hour. The synthesized humanized heavy chain library material (128.7 ng) was ligated in frame into a pCMA retroviral expression vector (1 μg) at a vector to insert ratio of 1:3. The ligation reaction was then precipitated and concentrated (8.3-fold) to a final DNA concentration of 94 ng/μl.

The whole (3×4 μl) concentrated ligation reaction was electroporated into 80 μl of DH10B cells (*E. coli* ElectroMax DH10B electrocompetent cells, Invitrogen, Cat No 12033-015) (1900V/5 ms). 1000 μl SOC medium (Invitrogen, Cat No 15544-034) was added and the transformed DH10B cells recovered at 37° C. for 1 hour. A 1:1000 dilution was performed to determine the library complexity. The whole transformation reactions were plated onto LB-agar +100 μg/ml ampicillin plates and incubated over night at 37° C. The complexity of humanized VH chain library was determined to be 7.3E±07 and therefore the whole library diversity was recovered.

All electroporated bacteria were scratched from the plates and 2 glycerol stocks for long-term storage at −80° C. were prepared. A large-scale DNA plasmid preparation (Macherey & Nagel, NucleoBond Xtra Maxi Plus Kit) was performed. A digestion to verify the presence and the correct size of cloned insert humanized VH chain library material was performed with HindIII/Eco47III (H/E). To verify the correct vector backbone a KpnI/BsrGI (K/B) digestion was used. As a control the humanized VH chain library plasmid DNA was also digested with LguI to verify the amounts of the vector without insertions of humanized VH chains and the vector integrity was tested by separation of uncut plasmid DNA.

96 single clones were picked and sent for sequencing to determine the final library diversity using primer 89-AL (Sequence: 5' gcctccgcctcctcttcctccatcc 3'; SEQ ID NO: 707). No redundant sequences were identified in quality control. The theoretical diversity is 1.3E+06 different variants hence the coverage of each unique sequence is about 50 times. 35% of the library-clones had the desired mutation pattern (=2.5E+07) and all desired variants were present in the library.

6.4.2.2 Generation of a Humanized Light Chain Library

Synthesised humanized variable light chain regions (Eurofins MWG GmbH) were cloned into the retroviral expression vector containing immunoglobulin constant region (IGKC). Digestion and ligation were performed as described in section 6.4.2.1. The synthesized humanized light chain library material (227.9 ng) was ligated in frame into a pCMA retro-viral expression vector (0.5 µg) at a vector to insert ratio of 1:10. Afterwards the ligation reaction was precipitated and 3.6-fold concentrated to a final DNA concentration of 52 ng/gl.

Transformation was performed as described in Section 6.4.2.1 above. 2×4 µl concentrated ligation reaction was electroporated into 80 µl of DH10B cells (E. coli Electro-Max DH10B electrocompetent cells, Invitrogen, Cat No 12033-015) (1900V/5 ms). The complexity of the humanized VL chain library was determined to be 4.6E+07 and therefore the whole library diversity was recovered. The library plasmid DNA preparation and the verification of plasmid DNA was performed as described in Section 6.4.2.1. Only one redundant sequence was identified in quality control. The theoretical diversity is 7.7E+02 different variants hence the coverage of each unique sequence is about 60000 times. 65% of the library-clones had the desired mutation pattern and all desired variants were present in the library.

6.4.3 Recovery of Germlined Heavy and Light Chains from Pre-Selected preB Cell Clones The humanized library material generated as described above (Sections 6.4.2.1 and 6.4.2.2) was used in an affinity maturation Retrocyte Display® screen to identify antibodies with a high germline gene content and improved biological and biochemical properties. From two 96 well plates, containing 80 and 96 pre-selected preB cell clones, heavy and light chains were recovered. The cells were lysed (Phusion Human Specimen Direct PCR Kit, Thermo Scientific/Finnzymes Cat. No. F-150) and the variable regions were amplified directly by PCR (see Table 15). The PCR was performed with a specific 5' forward and 3' reverse primer (see Table 16). As a template for the PCR 2 µl preB cell lysate was used. Amplified variable regions were purified (NucleoFast 96 PCR (Macherey-Nagel)) and cloned into the CHO expression vectors (pPEP) containing immunoglobulin constant region (IGHG1, IGKC).

TABLE 15

PCR Programs

| | | | |
|---|---|---|---|
| 1. Initial denaturation | 98° C. | 5 min | 34 cycles |
| 2. Denaturation | 98° C. | 1 s | |
| 3. Annealing/Elongation | 72° C. | 15 s | |
| 11. Final elongation | 72° C. | 1 min | |
| 12. Cooling | 10° C. | Hold | |
| Total no of cycles | | 35 | |

TABLE 16

Primers to amplify the heavy and kappa light chain variable regions

| Name | Sequence | SEQ ID NO: |
|---|---|---|
| PCR forward Primers (5') | | |
| 5' hum231-32-15 Vh LguI (1192-Je) | 5' tctgctcttctaccat ggattggacttggcgcat tctgttc 3' | 708 |
| 5' hum231-32-15 Vk LguI (1193-Je) | 5' cttgctcttctatggt gttacagactcaggtgttc 3' | 709 |
| PCR reverse Primers (3') | | |
| 3' H LguI Cg (1060-Je) | 5' tacgctcttcaagctg ctggagggcacgg 3' | 710 |
| 3' K LguI Ck (1065-Je) | 5' cttgctcttcgctcag cgtcagggtgct 3' | 711 |

To clone the pre-selected germlined heavy and light chain variable regions, digestion and ligation were performed in one step and one tube using the typeIIS restriction enzyme LguI and T4-DNA Ligase at 37° C. for 1 h and a final step at 80° C. for 10 min, and the pre-selected germlined heavy or light chain variable regions (~60 ng) were ligated in frame into pPEP expression vectors (50 µg). A vector to insert ratio of 1:12 was used.

2 µl pre-selected germlined heavy chain ligation reactions and 6 µl pre-selected germlined kappa light chain ligation reactions were co-transformed in chemical competent DH10B cells (30 µl) by heat shock transformation. 1000 µl SOC medium (Invitrogen, Cat No 15544-034) was added and the transformed DH10B cells recovered at 37° C. for 1 hour. Finally 1000 µl LB-medium+ampicillin (final concentration: 100 µg/ml) was added and the transformed E. coli cells incubated overnight at 37° C. A DNA plasmid preparation in small-scale (Macherey & Nagel, NucleoSpin 96 Plasmid) was carried out and a digestion to verify the presence and the correct size of cloned variable regions was performed with HindIII/NotI (VH chains) and NcoI (VK chains). The vector integrity was tested by separation of uncut plasmid DNA. The DNA plasmid preparations were subsequently used to transfect CHO cells and the expressed antibodies were tested using suspension array technology and in kinetic analysis by Octet. Antibody sequences were verified by PCR.

6.4.4 Selection of Germline Variants

Several hundred germlined antibodies were selected based on binding kinetics as determined by Octet measurements (Octet RED 96 system; ForteBio™ Inc., Menlo Park, Calif.). The experimental procedure was configured according to the instruction manual of the instrument. Biotin-GITR was bound to Streptavidin biosensor (SA) and PBS (pH 7.4)

was used as a blank control. Briefly, the interaction analyses were conducted at 30° C. in running buffer (PBS, 0.05% Tween, pH7.4). Sensor tips were pre-wet for 10 minutes in running buffer immediately prior to use, and the micro plates used in the Octet were filled with 200 μl of sample or buffer per well and agitated at 800 rpm. For the experiments, commercially available precoated SA tips were used. Biotinylated GITR was loaded onto the ForteBio SA fibers in PBS pH7.4 for 10 minutes and washed for 4 minutes. For the association phase, the ligand-coated SA tips were immersed for 5 minutes in cell culture supernatant that was diluted 1:10 in running buffer prior to the measurement. Dissociation of the antibody-antigen complex was measured in wells containing the Octet buffer alone for 5 minutes. After each run, the tips were regenerated with Glycine (10 mM, pH 2.0). Affinity, $K_{on}$ and $K_{off}$ were determined with Octet evaluation software v6.3 using a 1:1 binding model with local full fitting. Table 17 lists the composition of the heavy chain variable regions and light chain variable regions of 56 select germline variants and their affinity, $K_{on}$ and $K_{off}$ values as measured by Octet.

TABLE 17

Kinetic analysis of germline variants

| Antibody ID | Heavy chain variable region (SEQ ID NO:) | Light chain variable region (SEQ ID NO:) | Affinity (M) | $k_{on}$ (1/Ms) | $K_{off}$ (1/s) |
|---|---|---|---|---|---|
| 1 | H1916A01 (215) | K1916A01 (400) | 7.44E−10 | 4.68E+05 | 3.48E−04 |
| 2 | H1916A03 (217) | K1916A03 (401) | 4.23E−09 | 5.53E+05 | 2.34E−03 |
| 4 | H1916A05 (219) | K1916A05 (403) | 1.43E−09 | 3.51E+05 | 5.01E−04 |
| 5 | H1916A06 (220) | K1916A06 (404) | 1.63E−09 | 5.91E+05 | 9.66E−04 |
| 6 | H1916A07 (221) | K1916A07 (405) | 2.70E−09 | 2.14E+05 | 5.79E−04 |
| 9 | H1916A10 (224) | K1916A10 (408) | 2.68E−09 | 2.93E+05 | 7.84E−04 |
| 10 | H1916A11 (225) | K1916A11 (409) | 9.11E−10 | 6.15E+05 | 5.60E−04 |
| 11 | H1916A12 (226) | K1916A12 (410) | 2.10E−09 | 4.03E+05 | 8.47E−04 |
| 15 | H1916B05 (230) | K1916B05 (415) | 2.22E−09 | 2.78E+05 | 6.16E−04 |
| 16 | H1916B06 (231) | K1916B06 (416) | 1.47E−09 | 3.56E+05 | 5.23E−04 |
| 18 | H1916B09 (233) | K1916B09 (419) | 3.77E−09 | 2.19E+05 | 8.24E−04 |
| 20 | H1916B12 (236) | K1916B12 (421) | 1.35E−09 | 2.83E+05 | 3.80E−04 |
| 21 | H1916C03 (237) | K1916C03 (423) | 8.44E−09 | 3.09E+05 | 2.61E−03 |
| 25 | H1916C07 (241) | K1916C07 (427) | 1.69E−09 | 3.74E+05 | 6.32E−04 |
| 29 | H1916C11 (245) | K1916C11 (431) | 1.06E−09 | 2.95E+05 | 3.13E−04 |
| 31 | H1916D01 (247) | K1916D01 (433) | 4.18E−10 | 5.05E+05 | 2.11E−04 |
| 33 | H1916D03 (249) | K1916D03 (435) | 9.01E−11 | 1.12E+07 | 1.01E−03 |
| 34 | H1916D04 (250) | K1916D04 (436) | 4.58E−10 | 5.57E+05 | 2.55E−04 |
| 35 | H1916D05 (251) | K1916D05 (437) | 1.87E−10 | 1.29E+06 | 2.40E−04 |
| 36 | H1916D06 (252) | K1916D06 (438) | 4.40E−10 | 6.38E+05 | 2.80E−04 |
| 37 | H1916D07 (253) | K1916D07 (439) | 3.17E−11 | 7.64E+06 | 2.42E−04 |
| 38 | H1916D08 (254) | K1916D08 (440) | 8.75E−11 | 8.57E+06 | 7.50E−04 |
| 39 | H1916D09 (255) | K1916D09 (441) | 2.55E−10 | 3.91E+06 | 9.97E−04 |
| 42 | H1916E01 (259) | K1916E01 (444) | 3.77E−10 | 4.17E+05 | 1.57E−04 |
| 43 | H1916E03 (261) | K1916E03 (445) | 1.28E−09 | 3.73E+05 | 4.77E−04 |
| 45 | H1916E05 (263) | K1916E05 (447) | 5.62E−10 | 4.55E+05 | 2.55E−04 |
| 46 | H1916E06 (264) | K1916E06 (448) | 6.19E−10 | 4.00E+05 | 2.48E−04 |
| 47 | H1916E08 (265) | K1916E08 (450) | 2.06E−09 | 3.91E+05 | 8.04E−04 |
| 49 | H1916E11 (268) | K1916E11 (452) | 2.09E−09 | 3.38E+05 | 7.07E−04 |
| 50 | H1916F03 (270) | K1916F03 (454) | 1.01E−09 | 2.52E+05 | 2.54E−04 |
| 52 | H1916F05 (272) | K1916F05 (456) | 1.07E−09 | 3.97E+05 | 4.26E−04 |
| 54 | H1916F09 (276) | K1916F09 (458) | 1.26E−09 | 5.48E+05 | 6.88E−04 |
| 55 | H1916F10 (277) | K1916F10 (459) | 1.27E−09 | 4.35E+05 | 5.50E−04 |
| 58 | H1916G04 (283) | K1916G04 (462) | 1.58E−09 | 2.63E+05 | 4.15E−04 |
| 59 | H1916G05 (284) | K1916G05 (463) | 1.04E−09 | 2.99E+05 | 3.12E−04 |
| 61 | H1917A02 (287) | K1917A02 (467) | 1.83E−09 | 7.72E+05 | 1.41E−03 |
| 68 | H1917B01 (298) | K1917B01 (474) | 1.55E−09 | 2.89E+05 | 4.47E−04 |
| 70 | H1917B04 (301) | K1917B04 (476) | 2.01E−09 | 4.37E+05 | 8.79E−04 |
| 71 | H1917B07 (304) | K1917B07 (477) | 2.41E−10 | 1.05E+06 | 2.52E−04 |
| 75 | H1917C09 (313) | K1917C09 (484) | 2.92E−09 | 3.17E+05 | 9.25E−04 |
| 76 | H1917C10 (314) | K1917C10 (485) | 2.72E−09 | 3.86E+05 | 1.05E−03 |
| 78 | H1917D01 (316) | K1917D01 (488) | 1.00E−09 | 3.25E+05 | 3.27E−04 |
| 79 | H1917D04 (319) | K1917D04 (489) | 2.87E−09 | 4.50E+05 | 1.29E−03 |
| 80 | H1917D07 (320) | K1917D07 (490) | 6.96E−10 | 6.52E+05 | 4.54E−04 |
| 85 | H1917E02 (327) | K1917E02 (495) | 1.28E−09 | 2.89E+05 | 3.70E−04 |
| 86 | H1917E03 (328) | K1917E03 (496) | 7.50E−10 | 5.77E+05 | 4.32E−04 |
| 91 | H1917F03 (340) | K1917F03 (501) | 3.07E−09 | 5.20E+05 | 1.59E−03 |
| 92 | H1917F05 (342) | K1917F05 (502) | 1.01E−09 | 3.57E+05 | 3.61E−04 |
| 94 | H1917G01 (350) | K1917G01 (504) | 1.18E−09 | 3.72E+05 | 4.40E−04 |
| 95 | H1917G05 (354) | K1917G05 (505) | 2.21E−09 | 3.05E+05 | 6.72E−04 |
| 96 | H1917G06 (355) | K1917G06 (506) | 1.09E−09 | 3.44E+05 | 3.73E−04 |
| 97 | H1917G07 (356) | K1917G07 (507) | 1.43E−09 | 5.34E+05 | 7.61E−04 |
| 101 | H1917H01 (362) | K1917H01 (511) | 3.54E−10 | 9.36E+05 | 3.32E−04 |
| 102 | H1917H02 (363) | K1917H02 (512) | 1.97E−09 | 3.21E+05 | 6.32E−04 |
| 105 | H1917H07 (366) | K1917H07 (516) | 1.38E−09 | 3.51E+05 | 4.86E−04 |
| 107 | H1917H09 (368) | K1917H09 (518) | 2.21E−09 | 2.98E+05 | 6.57E−04 |

Of these antibodies, a number were chosen for subsequent analysis based on further Octet values and their germline homology. From these, a sample of antibodies, which were all agonistic in a T cell assay (data not shown), were characterized in more detail as described below. FIG. 23 details the composition of the heavy and light chain variable regions of these selected germline variants. FIGS. 24A, 24B and 24C detail the composition of the heavy and light chain regions of other select actual or prophetic germline variants.

6.4.5 Kinetic Analysis of Germline Variants

Quantification and binding analysis of the anti-GITR germline variant antibodies was determined using suspension array technology following the methods as described in Section 6.2.5.1. The mean relative affinities of the germline variants compared to the chimeric parental 231-32-15 antibody are shown in FIG. 23.

Figure 25A:
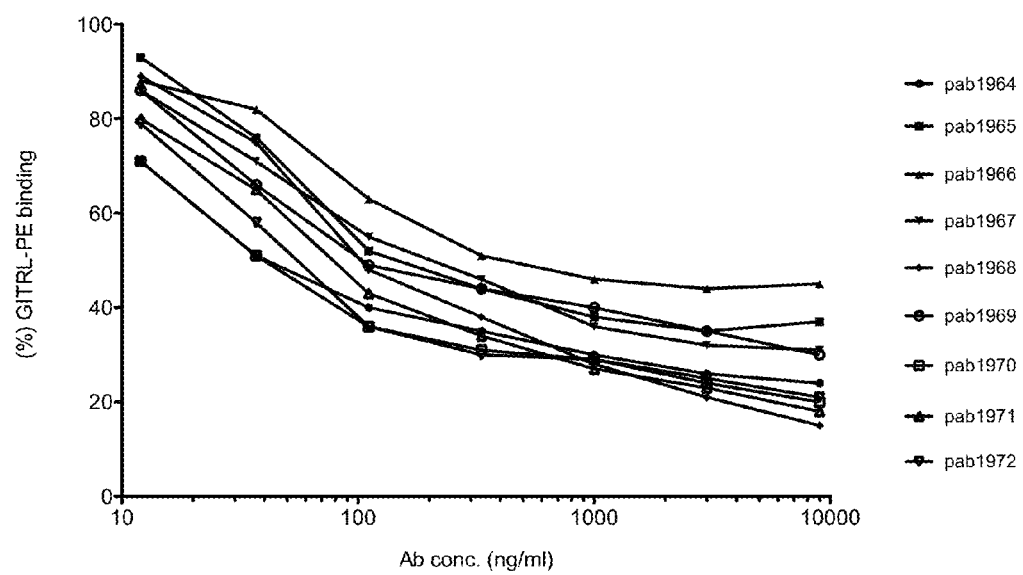
Figure 25B:
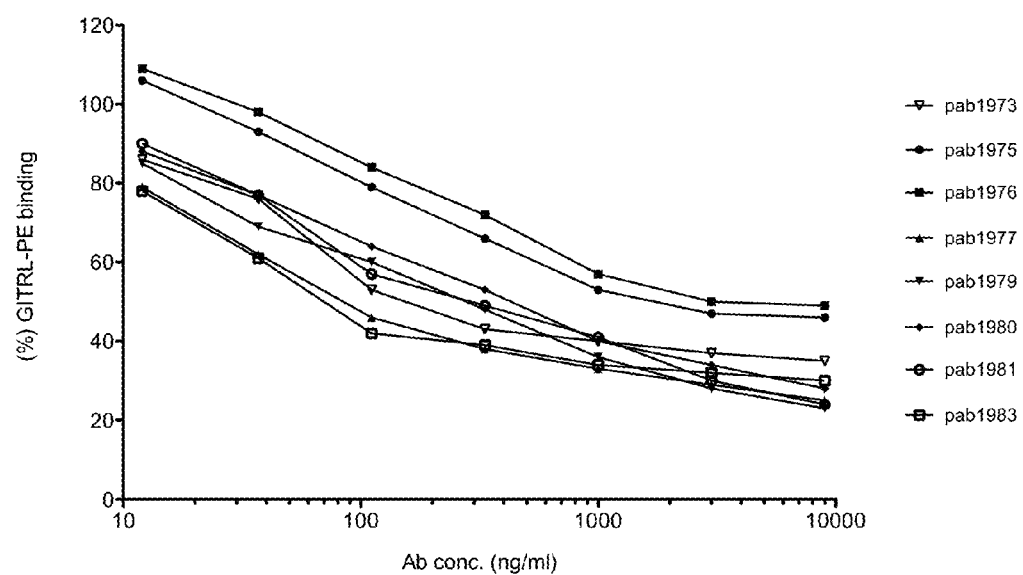

In addition, an assessment of ligand blocking activity using suspension array technology was also carried out according to the method described in Example 6.2.5.2. As can be seen in FIGS. 25A and 25B, GITRL-PE binding to GITR in the presence of a selection of germline variant antibodies followed a very similar pattern for the antibodies tested.

These germline variant antibodies were further characterized in functional assays as described below in Example 5.

6.5 Example 5: Functional Activity of Germline Variants 6.5.1 Effect of Germline Variants on Anti-CD3 Stimulated CD4+ T Cell Proliferation and Cytokine Production In order to assess the activity of new germline variants generated as described in Example 4, these variants were compared to the humanized antibodies Hum231#1 and Hum231#2 and the chimeric parental 231-32-15 antibody on enriched CD4 T cells from four buffy coat preparations, BC4, BC9, BC13 and BC18.

A suboptimal CD3 stimulation assay was performed as described in Section 6.3.1 above with intracellular cytokine staining (BC13 and BC18), cytokine release (BC4 and BC9) and CFSE dilution (BC4 and BC9) measured 5 days after the stimulation assay was performed. Plate bound anti-CD3 and soluble anti-CD28 antibodies were used with plate bound anti-GITR antibodies, no antibody (CD3 alone), and an isotype control (antibody MSC8). Anti-GITR antibodies were used at a concentration of 10 µg/ml. For buffy coats 4 and 9, anti-CD3 antibody was used at a concentration of 125 ng/ml, anti-CD28 antibody at a concentration of 125 ng/ml and 10U IL-2. For buffy coat 13, anti-CD3 antibody was used at a concentration of 500 ng/ml and anti-CD28 antibody at a concentration of 100 ng/ml. For buffy coat 18, anti-CD3 antibody was used at a concentration of 31.25 ng/ml and anti-CD28 antibody at a concentration of 100 ng/ml.

Figure 26A:
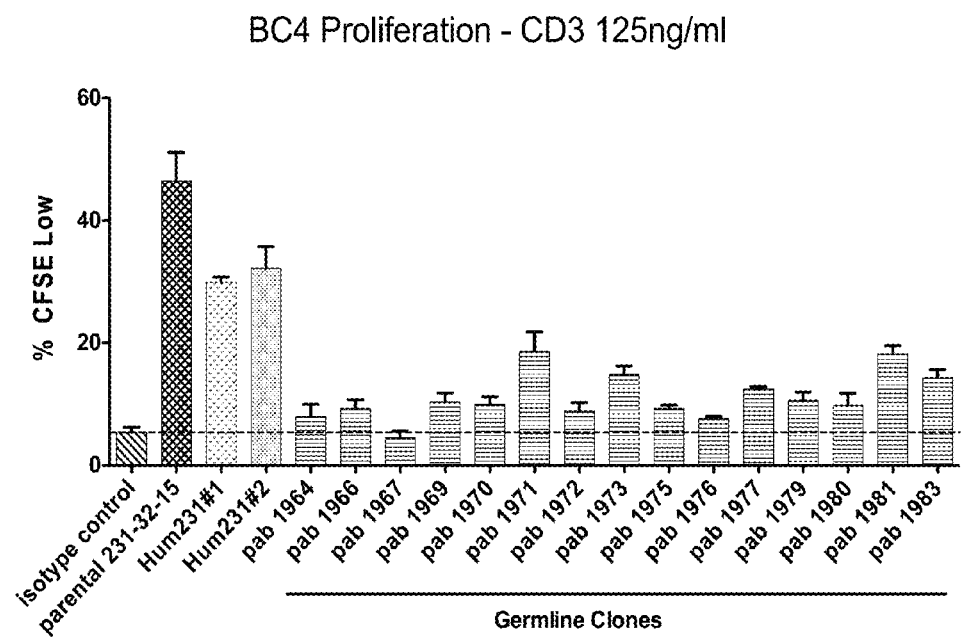
Figure 26B:
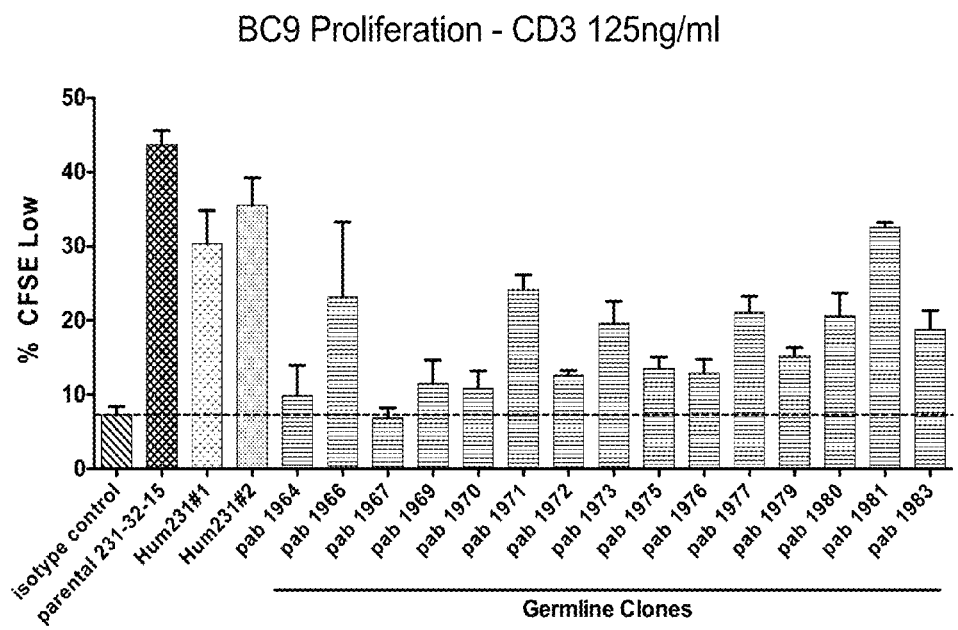
Figure 27A:
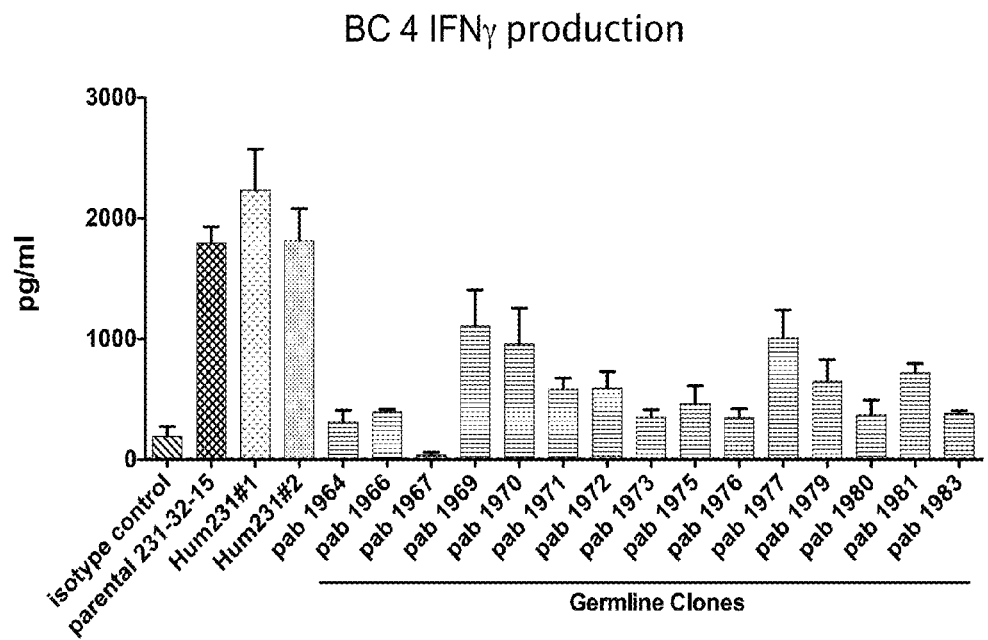
Figure 27B:
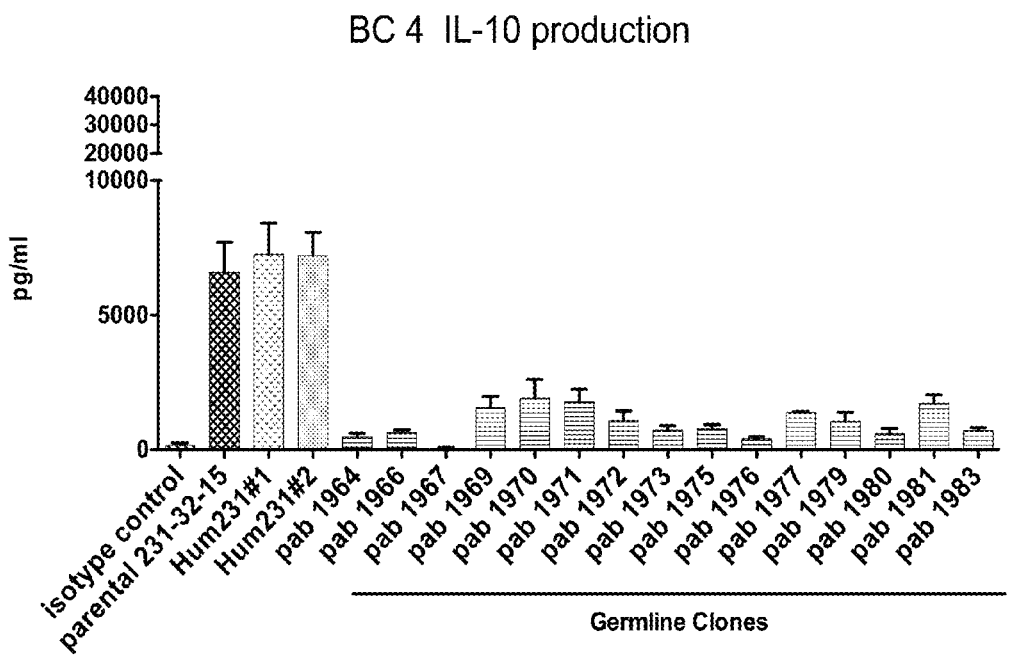
Figure 28A:
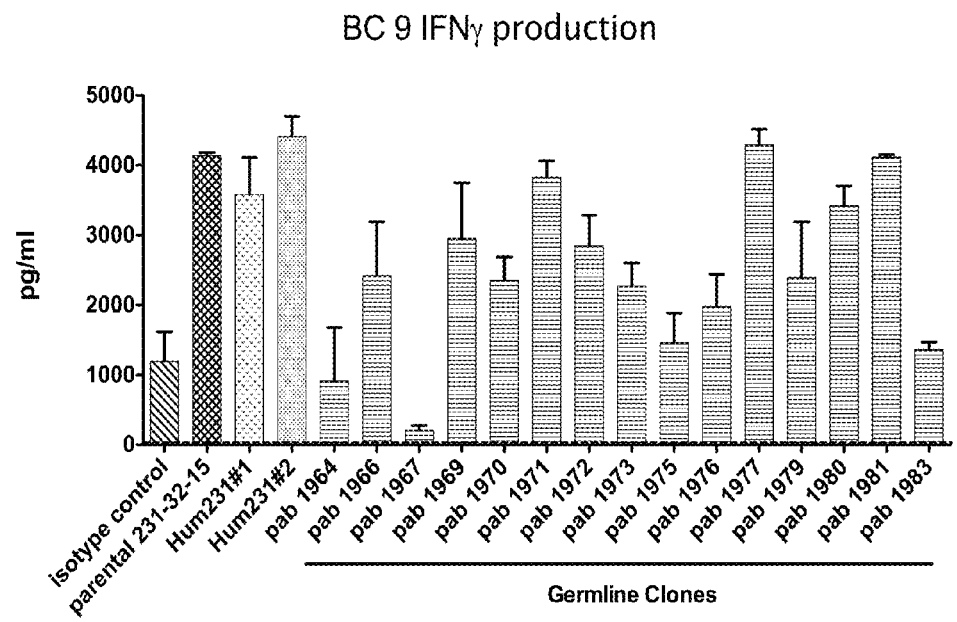
Figure 28B:
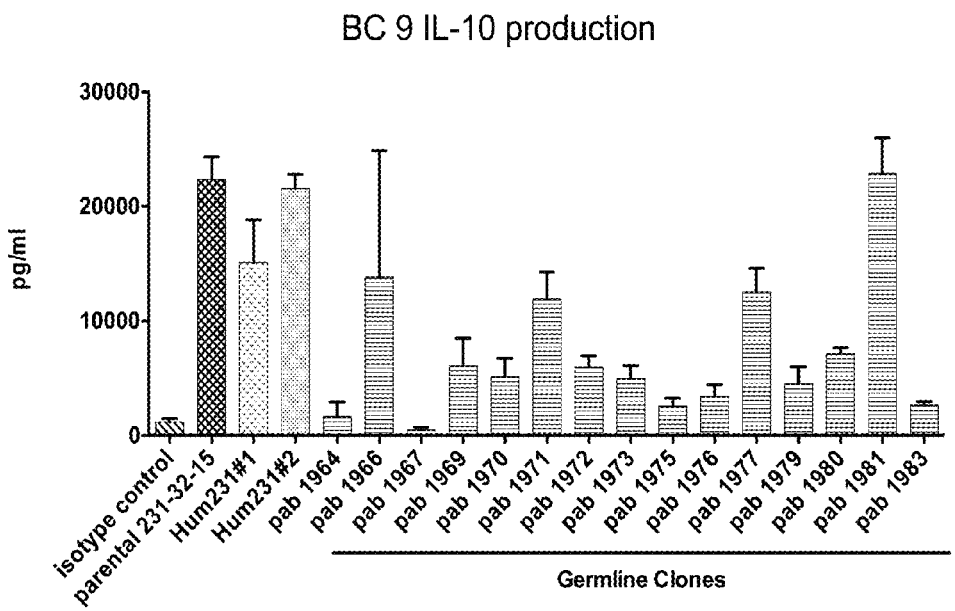

For the buffy coat preparations BC4 and BC9, the supernatants and cells were collected from the plate after 5 days in culture. Cell proliferation was determined and is shown as percentage CFSE low (FIGS. 26A and 26B) and the supernatants were used for cytokine analysis (IFNγ and IL-10). FIGS. 27A and 27B show cytokine release for BC4 and FIGS. 28A and 28B show cytokine release for BC9.

Figure 29A:
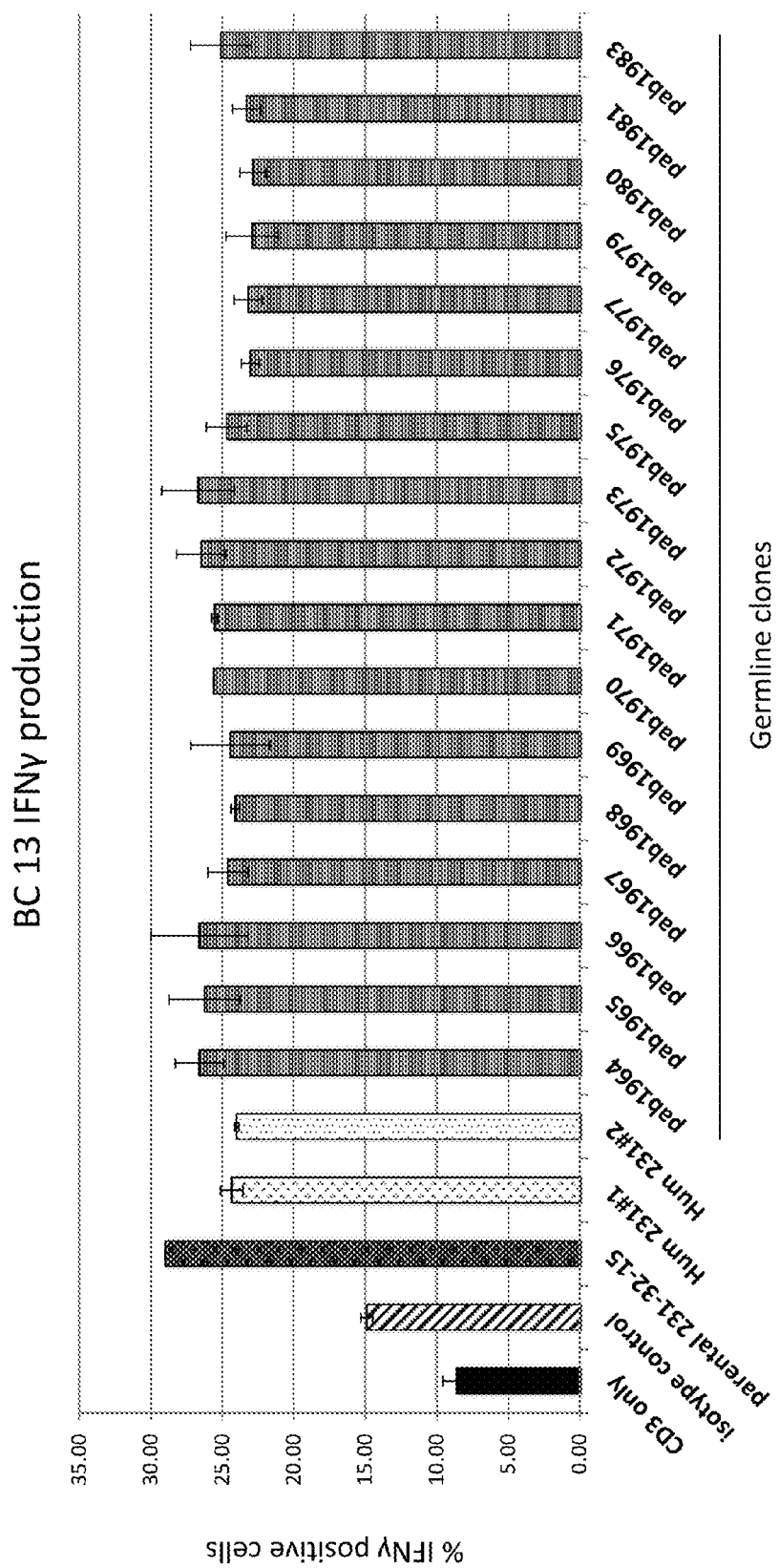
Figure 29B:
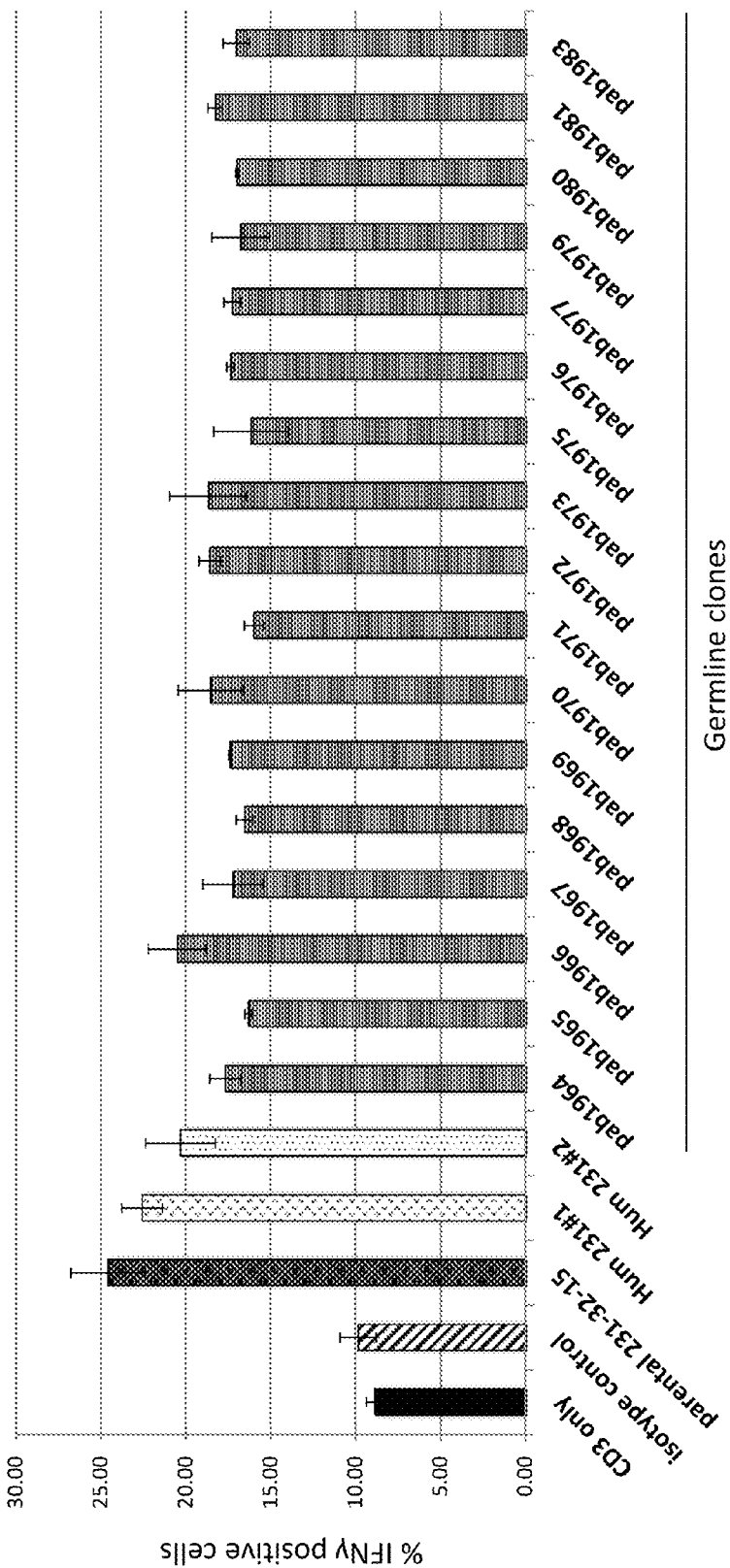

For buffy coat preparations BC13 and BC18, following 5 days in culture, monensin (eBioscience) was added to all samples for 6 hours to enable intracellular retention of IFNγ. The samples were then stained intracellularly for IFNγ-PE (eBioscience) using BD Cytofix/Cytoperm kit (BD Biosciences) following detection by flow cytometry on BD FACSAria I (BD Biosciences) and analysed using FlowJo software (Tree Star). Results of the effect of the germlined variants on the percentage of IFNγ positive CD4 T cells from BC13 and BC18 are shown in FIGS. 29A and 29B, respectively. Following contact with the germline variants, the chimeric parental 231-32-15 antibody or the humanized variants Hum231#1 and Hum231#2, the percentage of IFNγ positive CD4 T-cells induced by these anti-GITR antibodies were comparable. However, as expected, there is some slight variation between the donors.

6.5.2 Effect of Germline Variants on GITR NF-κB-Luciferase Reporter Cell Line

In this example, the germline variants generated as described in Example 4 were tested using the GITR NF-κB-luciferase reporter cell line (Promega) described in Section 6.3.8.

The reporter cell line (Promega) was kept in culture according to the manufacturer's instruction. On the day of the experiment, the cells were resuspended in assay media (RPMI+1% FBS). The cells (100,000 cells per well) were added to a 96-well plate that contained plate-bound anti-CD3 antibody (clone SP34, 0.3 µg/ml) and various concentrations (12.5, 10, 5, 2.5, 1.25, 0.625 and 0 µg/ml) of plate-bound anti-GITR antibodies. The reporter cells were incubated for 18 hours at 37° C. and 5% $CO_2$. After the incubation, luciferase expression was detected using Bio-Glo (Promega) and an EnVision multilabel reader 2100.

Figure 30A:
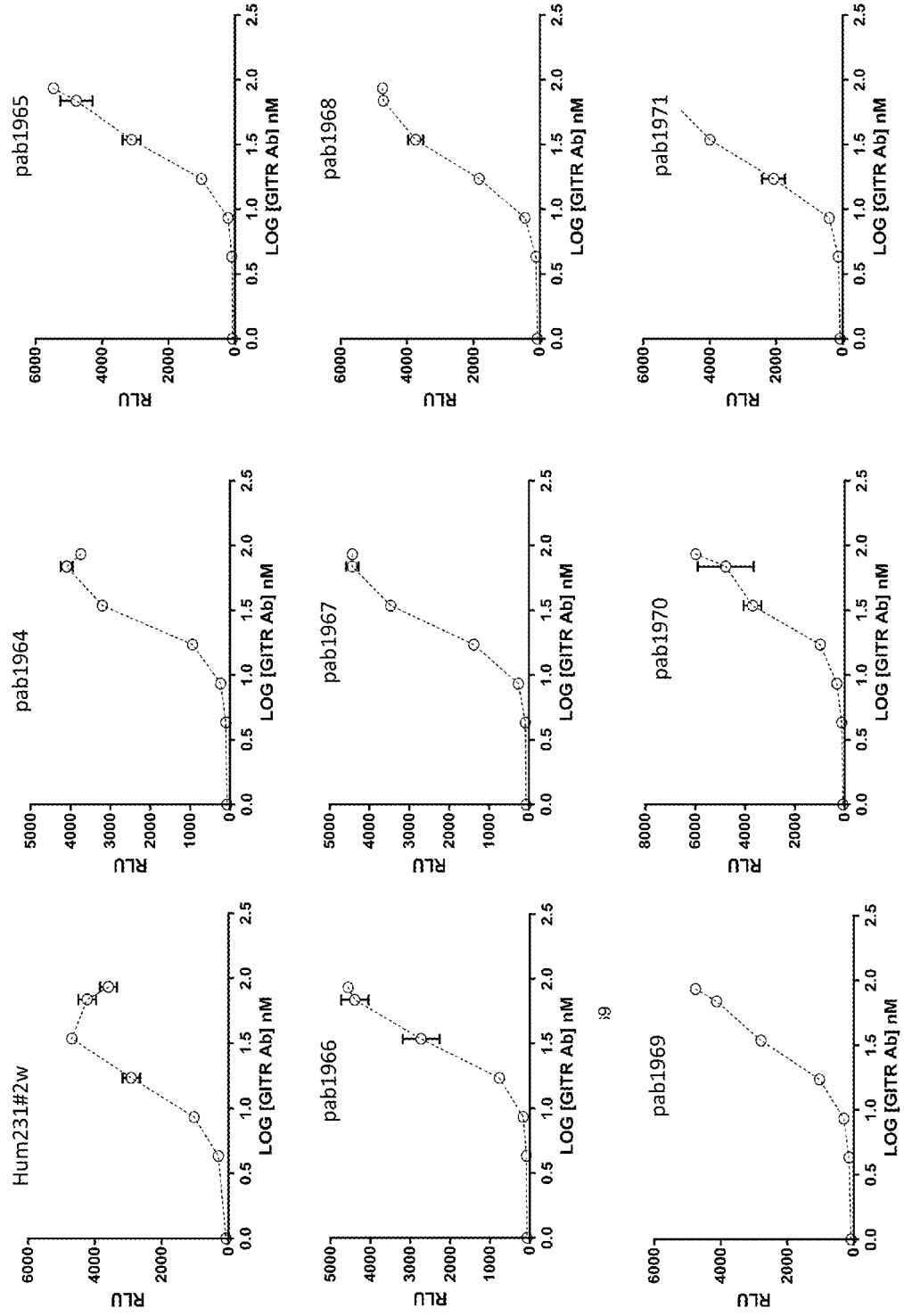
Figure 30C:
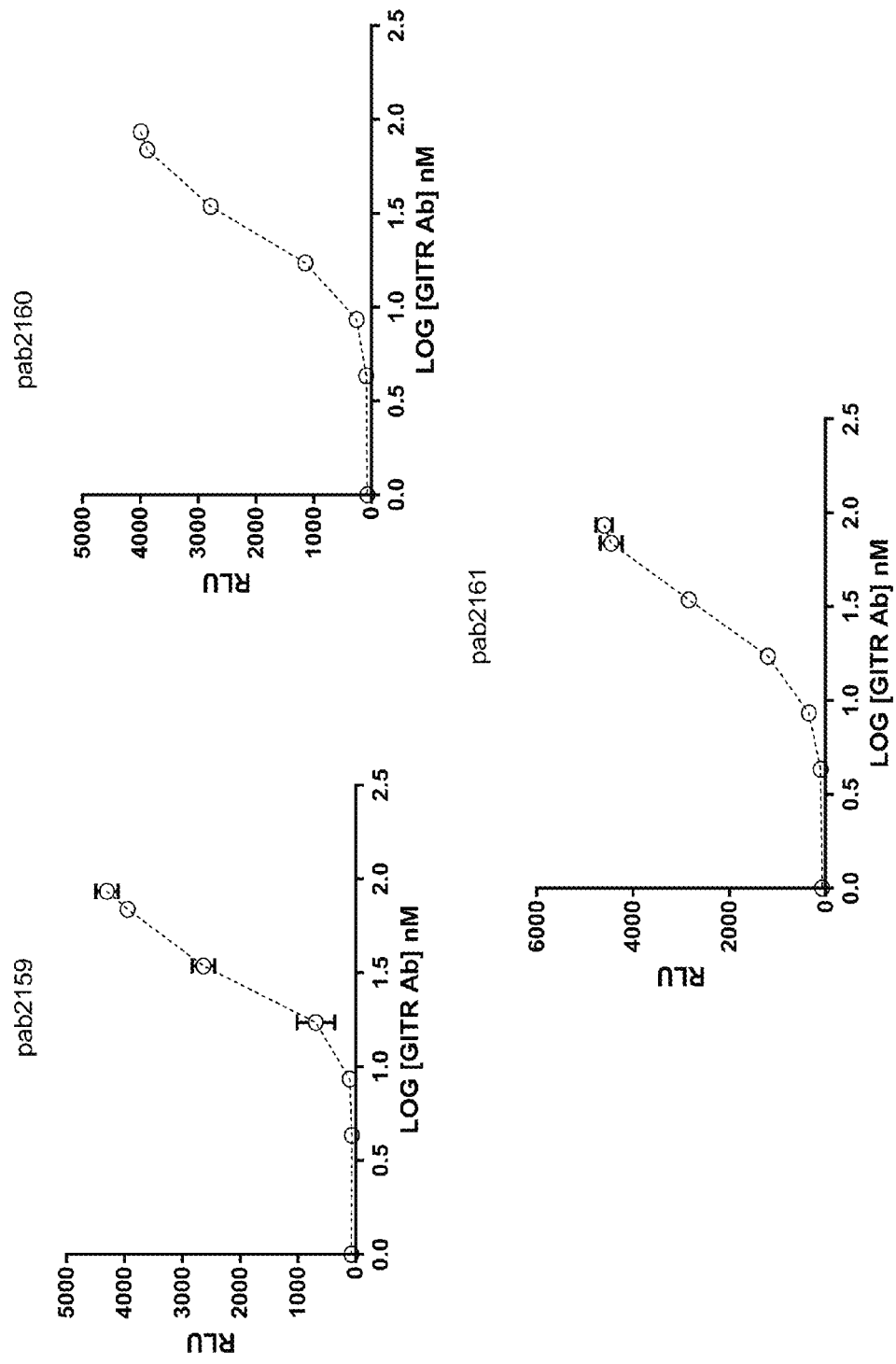

The anti-GITR antibodies tested in this assay were Hum231#2w and 20 germline variants: pab1964, pab1965, pab1966, pab1967, pab1968, pab1969, pab1970, pab1971, pab1972, pab1973, pab1975, pab1976, pab1977, pab1979, pab1980, pab1981, pab1983, pab2159, pab2160 and pab2161. As shown in FIGS. 30A-C, all the germline variants showed agonistic activity in the GITR NF-κB-luciferase reporter assay.

The germline variants were also tested for agonistic activity in the absence of anti-CD3 antibody. On the day of the experiment, the GITR NF-κB-luciferase reporter cells (Promega) were resuspended in assay media (RPMI+1% FBS). The cells (100,000 cells per well) were added to a 96-well plate that contained various concentrations (12.5, 10, 5, 2.5, 1.25, and 0.625 µg/ml) of plate-bound anti-GITR antibodies. The reporter cells were incubated for 6 hours at 37° C. and 5% $CO_2$. After the incubation, luciferase expression was detected using Bio-Glo (Promega) and an EnVision multilabel reader 2100.

Figure 30D:
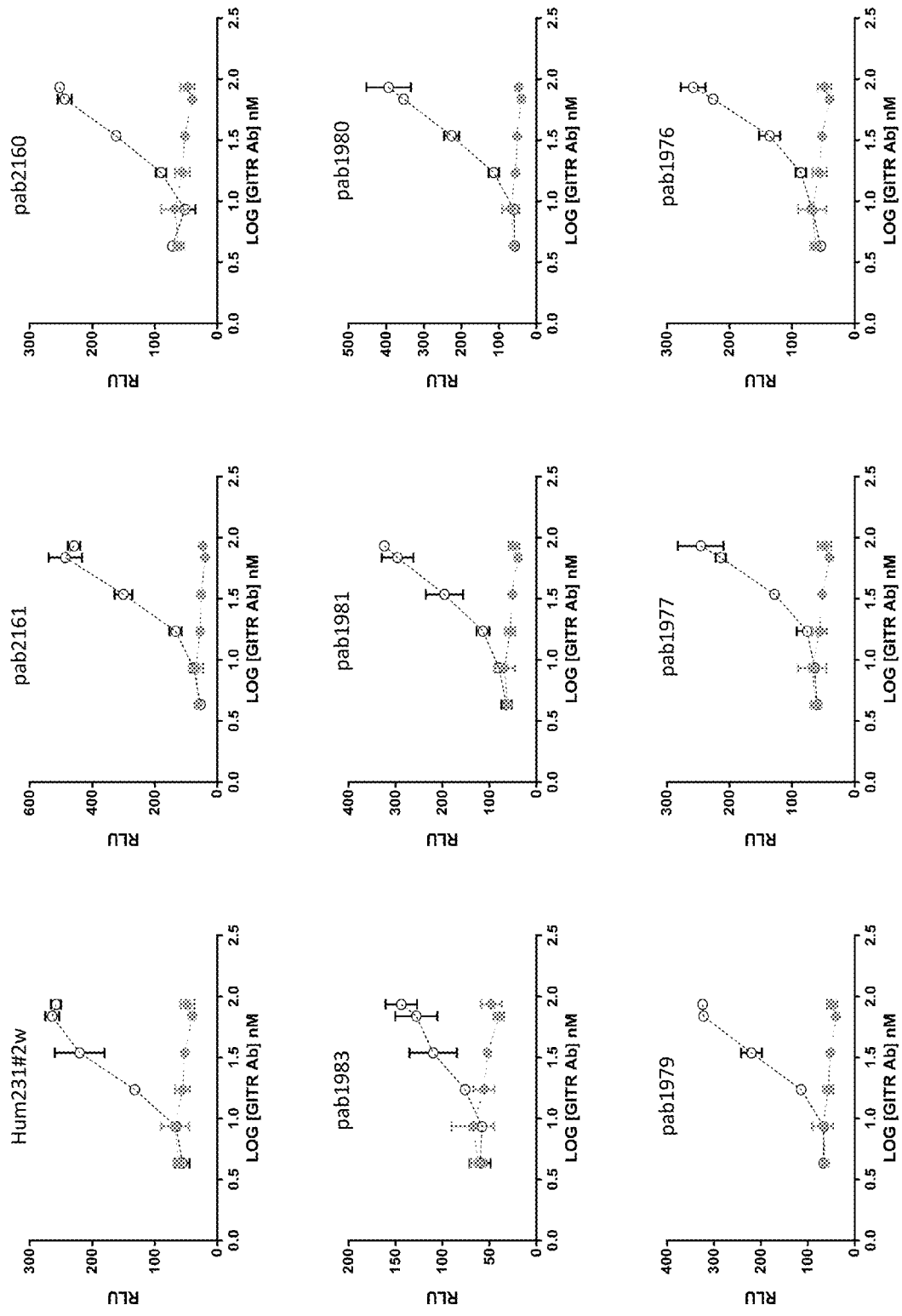
Figure 30E:
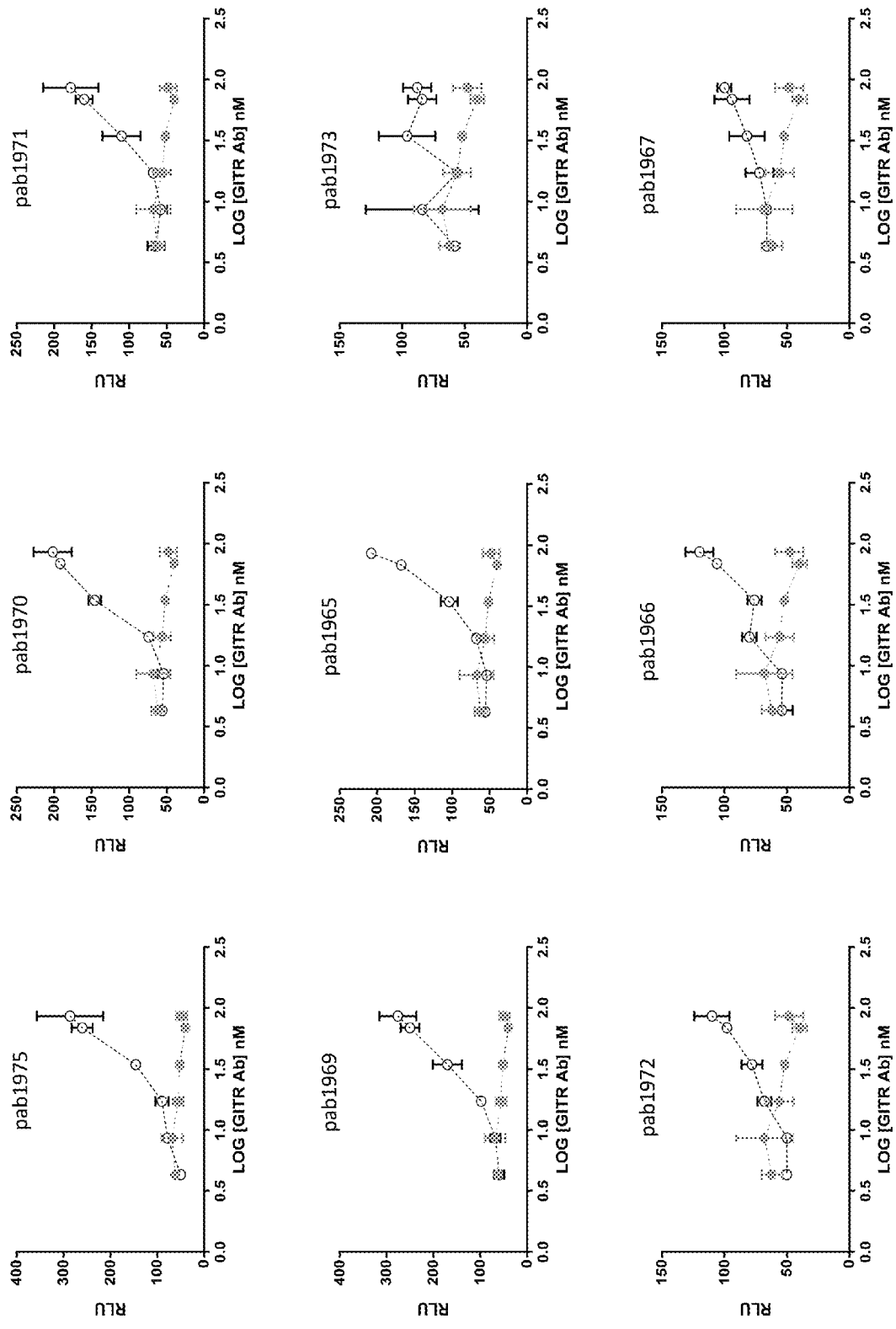
Figure 30F:
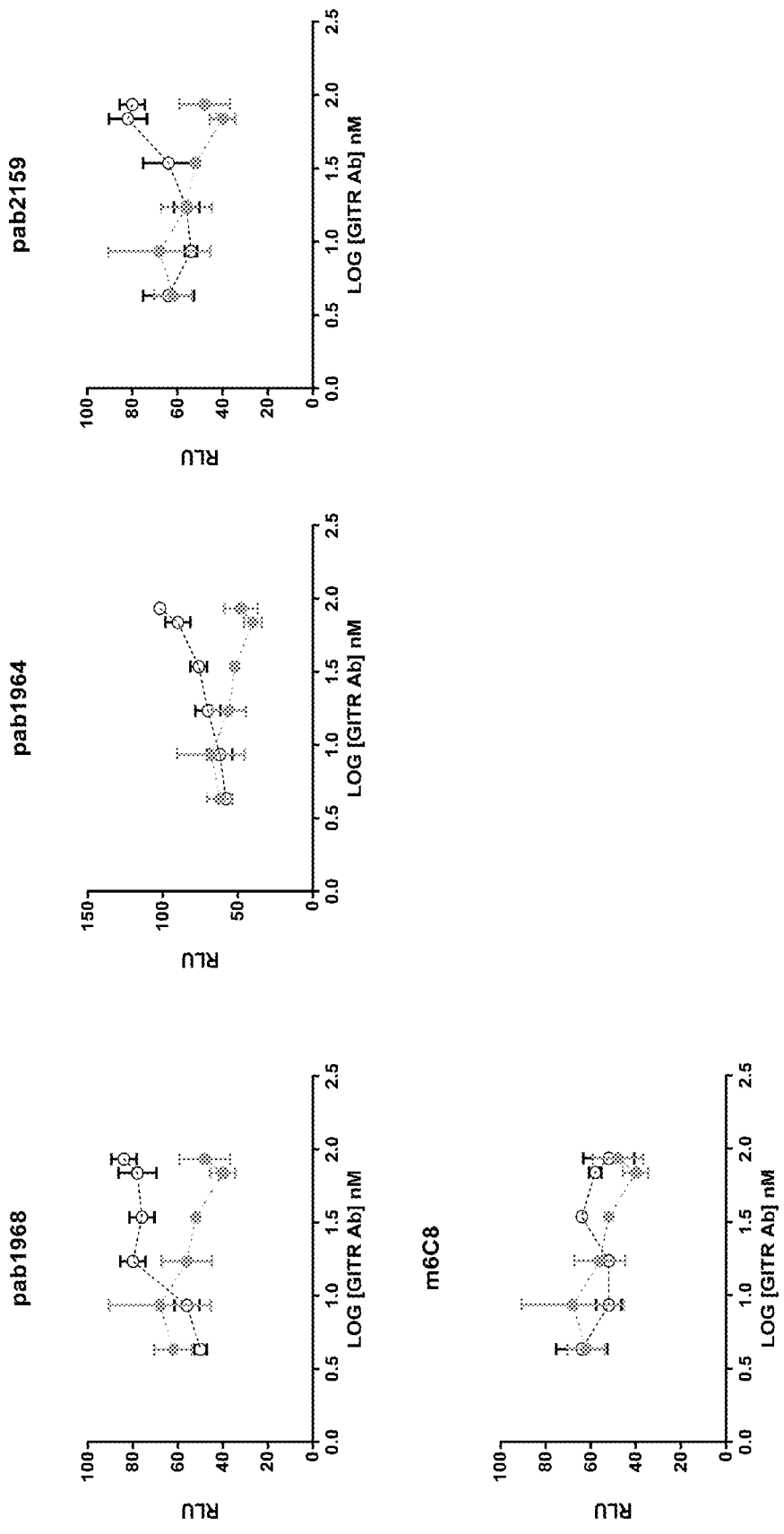

The anti-GITR antibodies tested in this assay were m6C8, Hum231#2w and 20 germline variants: pab1964, pab1965, pab1966, pab1967, pab1968, pab1969, pab1970, pab1971, pab1972, pab1973, pab1975, pab1976, pab1977, pab1979, pab1980, pab1981, pab1983, pab2159, pab2160 and pab2161. All the germline variants induced a dose dependent activation of the reporter cell line in the absence of an anti-CD3 antibody (FIGS. 30D-F).

6.6 Example 6: Epitope Characterization of Anti-GITR Antibodies

To characterize the epitope on human GITR to which the chimeric parental 231-32-15 antibody and the humanized anti-GITR antibodies recognize, further studies were performed as described below.

6.6.1 Epitope Competition—Cell Binding Assay

To confirm that the humanized variant antibodies retained the epitope specificity of the parental chimeric 231-32-15 antibody a cell binding assay was performed. 1624-5 pre-B cells expressing the chimeric parental 231-32-15 antibody were harvested and 1×10⁶ cells were resuspended in 200 µl FACS buffer plus: i) biotinylated GITR (GITR-bio) (1:1000), preincubated for 15 min with 2 µg chimeric parental 231-32-15 antibody; ii) GITR-bio (1:1000), preincubated for 15 min with 2 µg Hum231#1; iii) GITR-bio (1:1000), preincubated for 15 min with 2 µg Hum231#2; or iv) GITR-bio (1:1000). The cells were incubated for 20 min at 4° C. and then washed with 4 ml FACS buffer and centrifuged for 5 min at 300 g at 4° C. The cell pellet was resuspended in 200 µl FACS buffer plus streptavidin-PE (1:1000) and then incubated and washed as before. The cells were then resuspended in 200 µl FACS buffer for analysis using a FACS-Arian (BD Biosciences).

Figure 31:
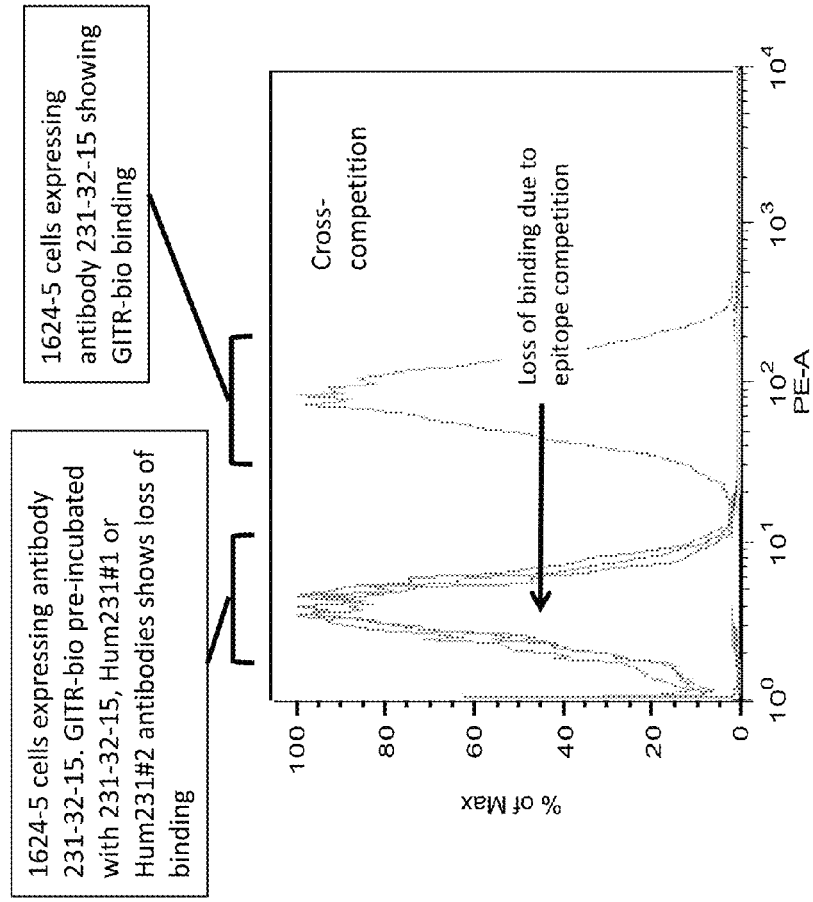

FIG. 31 shows that the humanized variant antibodies retained the epitope specificity of the chimeric parental 231-32-15 antibody. The right-hand profile shows the binding of GITR-bio to 1624-5 pre-B cells expressing the chimeric parental 231-32-25 antibody. However, when GITR-bio was pre-incubated with either chimeric parental 231-32-15, Hum231#1 or Hum231#2 antibodies there was a loss of binding of GITR-bio to the 1624-5 cells (left-hand profile). The overlapping FACS profiles indicate that the humanized variants also show very similar GITR binding properties to each other and to the chimeric parental 231-32-15 antibody.

6.6.2 Epitope Competition—Suspension Array Technology

Anti-GITR antibodies (25 µl) were diluted to 2 µg/ml in assay buffer (Roche 11112589001) and incubated with 1500 Luminex® beads (5 µl, Luminex Corp, no 5 LC10005-01) coupled with anti-human IgG (F(ab)$_2$-specific, JIR, 105-006-097) over night in 0.5 ml LoBind tubes (Eppendorf, 0030108.116) under shaking conditions, in the dark. This mixture was then transferred to pre-wetted 96-well filter plates (Millipore, MABVN1250). Plates were washed twice with 200 µl/well PBS to remove unbound antibody. At the same time 20 µg/ml of either the same anti-GITR antibodies, different anti-GITR antibodies, or assay buffer were incubated with 20 µl (1 µg/ml) R-PE labeled GITR antigen (R&D systems, di-sulfide-linked homodimer; 689-GR; in-house labeled with AbDSerotec LYNX Kit, LNK022RPE) for 1 h in the dark at 650 rpm. The bead mixture and the antigen/antibody mixture were mixed 1:1 (20 µl from each) and incubated for one additional hour under shaking conditions (20° C., 650 rpm). Directly before the measurement 40 µl of assay buffer was added to each well and analysis was performed using a Luminex® 200 system (Millipore) and a readout of 100 beads in 48 µl sample volume. Binding was determined using the MFI values of the non-competed control (100% binding, only assay buffer as competing compound).

When the chimeric parental 231-32-15 antibody was used as the captured antibody, full binding competition was observed with both humanized variants. When the anti-GITR antibody m6C8 was used as the captured antibody, no competition of binding was observed with the chimeric parental 231-32-15 antibody or the two humanized variants (data not shown). These results indicate that m6C8 and the anti-GITR antibodies described herein recognize different epitopes on human GITR.

6.6.3 Epitope Competition—Surface Plasmon Resonance

For epitope binning using surface plasmon resonance the "in tandem approach" was used (Abdiche Y N et al., (2009) Analytical Biochemistry, 386: 172-180). For that purpose different chip surfaces were generated on a CM5 sensor chip (GE Healthcare, Series S CM5, BR-1005-30) using immobilization of different densities of GITR antigen (R&D systems, disulfide-linked homodimer; 689-GR). Flow cell 2 contained GITR antigen in low density (667 RU), medium density was assessed in flow cell 3 (1595 RU) and in flow cell 4, high density was achieved (4371 RU). In flow cell 1 ovalbumin (1289 RU, Pierce ThermoFisher 77120) was immobilized for reference. Immobilization was performed according to a standard protocol from the manufacturer (GE Healthcare) for amine coupling (activation of surface with 0.4M EDC and 0.1M NHS, GE Healthcare Amine coupling kit, BR-1000-50). Unreacted groups were inactivated with 1M ethanol-amine-HCl pH8.5. Afterwards anti-GITR antibodies were run through the different surfaces at a concentration of 300 nM (45 µg/ml) for 240s at 5 µl/min. Using these conditions saturation of the GITR surface should have been reached. A dissociation time of 60s was included before adding the competing antibody (300 nM, 5 µl/min). Regeneration of the chip surface was performed using 10 mM Glycine pH2.0 (GE Healthcare, BR-1003-55) for 60s at 10 µl/min. Binning was performed using the response units (RU) of the non-competed control (100% binding, saturating conditions).

Figure 32:
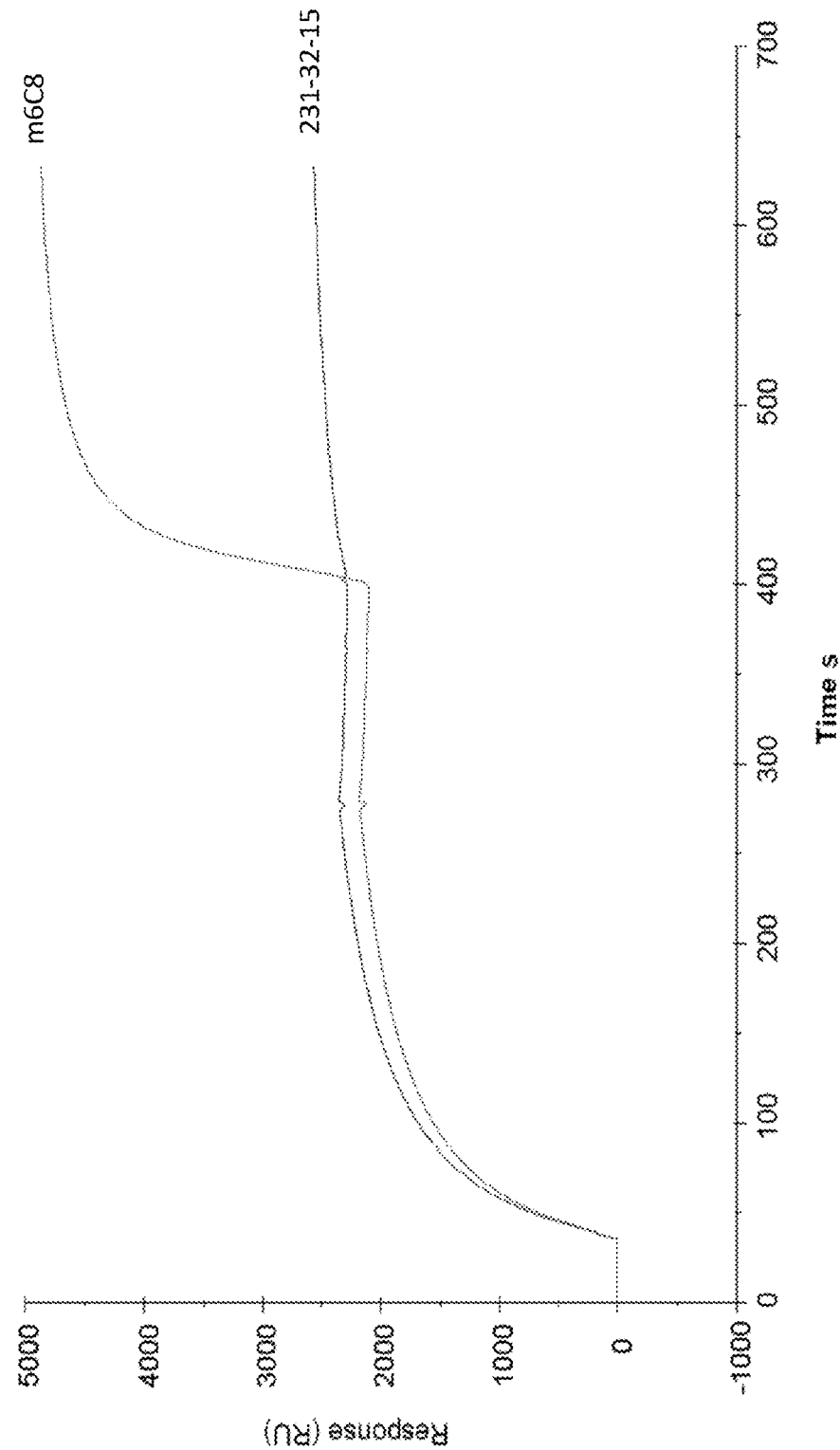

As is shown in FIG. 32, when the chimeric parental 231-32-15 antibody is first bound to GITR no further binding of this antibody occurs. However when the chimeric parental 231-32-15 antibody is first bound to GITR and the antibody m6C8 is applied, this antibody is still able to bind to GITR.

6.6.4 Epitope Mapping of Anti-GITR Antibodies

In order to map the epitope on GITR to which anti-GITR antibodies described herein bind, error prone PCR was used to generate variants of the human GITR antigen. The variant GITR proteins were expressed on the surface of cells in a cellular library and these cells were screened for binding of the anti-GITR antibodies. As a positive control, a polyclonal anti-GITR antibody was used to confirm proper folding of the GITR protein. For variants of the human GITR antigen to which reduced or no antibody binding occurred, alanine scanning mutagenesis was performed to determine the precise epitope residues that were required for binding by the anti-GITR antibodies described herein.

6.6.4.1 Generation of Human GITR Variants

Error prone PCR mutagenesis was used to generate variants of human GITR with random mutations in the extracellular domain. For error prone PCR, the GeneMorphII Random Mutagenesis Kit (Stratagene) was used, according to the manufacturer's instructions. In brief, 20 PCR cycles in a volume of 50 µl was performed using an in-house construct as template (13 ng, construct number 4377 pMA-T-hu-GITR), 0.05U/µl Mutazyme II DNA polymerase, lx Mutazyme II reaction buffer, 0.2 µM of each primer (1152-Je (Sequence 5' gagctcctcgaggccaccatg 3'; SEQ ID NO: 712) and 1204-Je (Sequence 5' cgcggccgcgaattctta 3'; SEQ ID NO: 713)) and 0.2 mM of each deoxynucleoside-triphosphate (dATP, dCTP, dGTP, and dTTP). The samples were amplified by PCR (Eppendorf, Germany) using the following program: 95° C. for 2 min; 20 cycles of 95° C. for 30 sec, 56° C. for 30 sec, 72° C. for 1 min; and a final extension step of 72° C. for 10 min. The PCR product was gel purified using 1% agarose gel, the DNA band corresponding to the expected size of 720 bp was cut out and gel extraction was done using a NucleoSpin Gel and PCR cleanup kit from Macherey&Nagel according to the product manual. Purified DNA was ligated into an in-house expression vector via XhoI/EcoRI sites using T4 DNA ligase and a ratio of 1:3 (vector:insert). Ligation (25° C.) was stopped after 2 hours with a heat denaturation step for 10 min at 65° C. DNA from the ligation reaction was EtOH precipitated using yeast t-RNA. Standard digestion and ligation techniques were used. The ligation reaction was electroporated into DH10B cells (*E. coli* ElectroMax DH10B electrocompetent cells, Invitrogen; 1900V/5 ms). Electroporated bacteria were plated onto LB-agar+100 µg/ml ampicillin plates and approximately $1.9 \times 10^8$ colonies were obtained.

All electroporated bacteria were then scratched from the plates and used for large-scale plasmid preparation (Macherey&Nagel, NucleoBond Xtra Maxi Plus Kit), according to the manufacturer's instructions to generate a DNA library. A restriction enzyme digestion with XhoI/EcoRI and BsrGI/EcoRI was performed to quality control the library. Single clones were picked and sent for sequencing to determine the final library diversity using primer 1155-Je (fwd; Sequence 5' ccttgaacctcctcgttcg 3'; SEQ ID NO: 714).

6.6.4.2 Generation of a Cellular Library with Human GITR Variants

Standard techniques of transfection followed by transduction were used to express human GITR mutants on the surface of 1624-5 cells. For the generation of retroviral particles, a library and vectors expressing retroviral proteins Gag, Pol and Env were transfected into a retroviral packaging cell line (HEK cells) using X-tremeGENE 9 DNA transfection reagent (Roche Diagnostics GmbH, Germany). The resulting retroviral particles accumulated in the cell culture supernatant of the retroviral packaging cells. Two days post transfection cell-free viral vector particle-containing supernatants were harvested and subjected to spin-infection of 1624-5 cells. A transduction efficiency (% human GITR expressing cells) of roughly 4% was obtained. Upon continuous culture for at least one additional day, cells were selected using puromycin (1.5 µg/ml). Untransduced cells served as negative controls (NC). After antibiotic selection, most cells stably expressed the human GITR antigen library on the cell surface. Non-viable cells were removed via a Ficoll separation step.

FACS was used to select cells expressing correctly folded human GITR mutants using a polyclonal anti-GITR antibody and to subsequently select individual cells expressing human GITR variants that did not bind to the anti-GITR chimeric parental 231-32-15 antibody. In brief, antibody binding cells were analyzed by FACS and cells that exhibited specific antibody binding were separated from the non-binding cell population by preparative, high-speed FACS (FACSAriaII, BD Biosciences). Antibody reactive or non-reactive cell pools were expanded again in tissue culture and, due to the stable expression phenotype of retrovirally transduced cells, cycles of antibody-directed cell sorting and tissue culture expansion were repeated, up to the point that a clearly detectable anti-GITR antibody (chimeric parental 231-32-15) non-reactive cell population was obtained. This anti-GITR antibody (chimeric parental 231-32-15) non-reactive cell population was subjected to a final, single-cell sorting step. After several days of cell expansion, single cell sorted cells were again tested for non-binding to anti-GITR chimeric parental 231-32-15 antibody and binding to a polyclonal anti-GITR antibody using 96 well plate analysis on a FACSCalibur (BD Biosciences).

6.6.4.3 Epitope Analysis

Figure 33A:
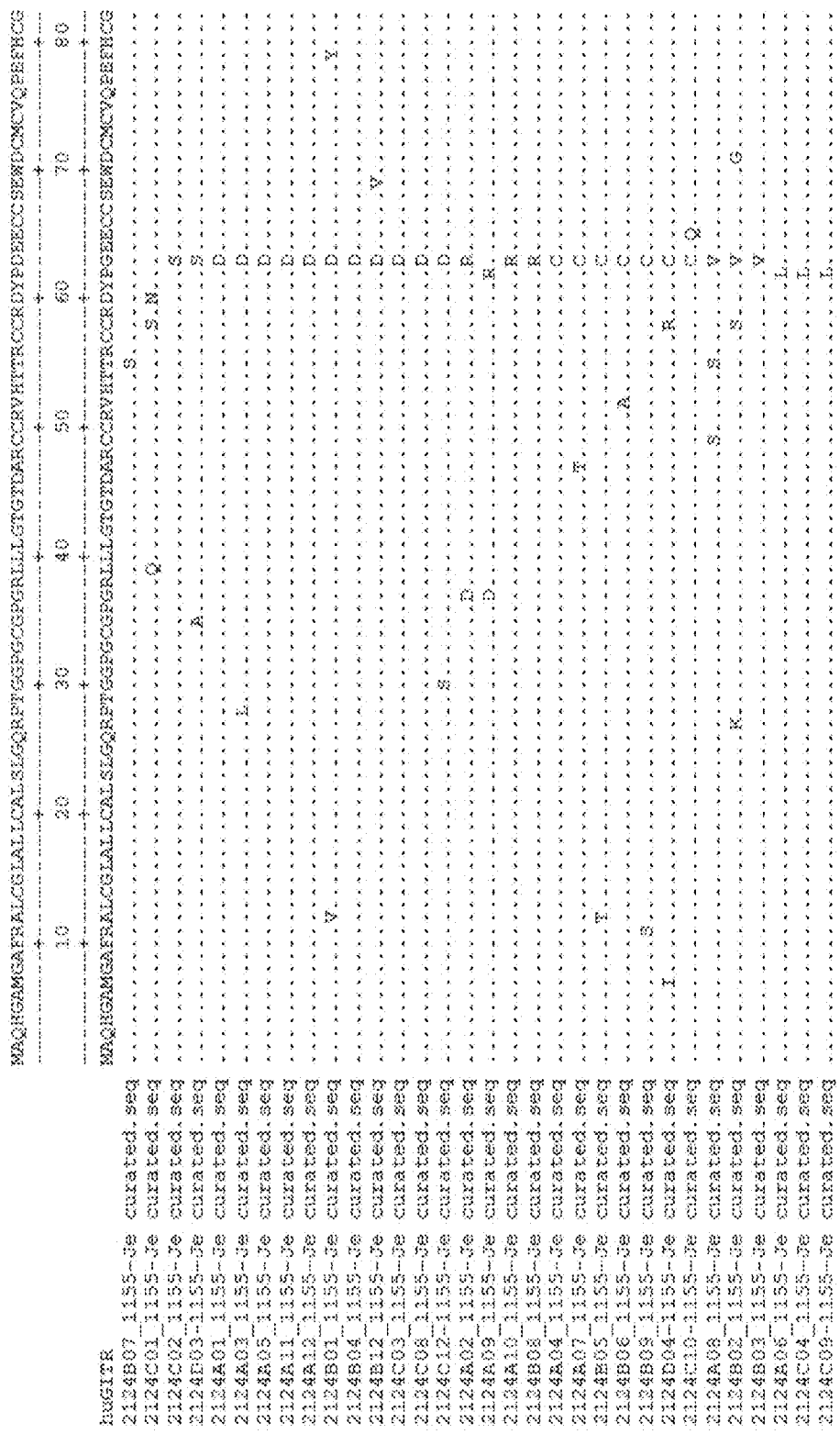
Figure 33B:
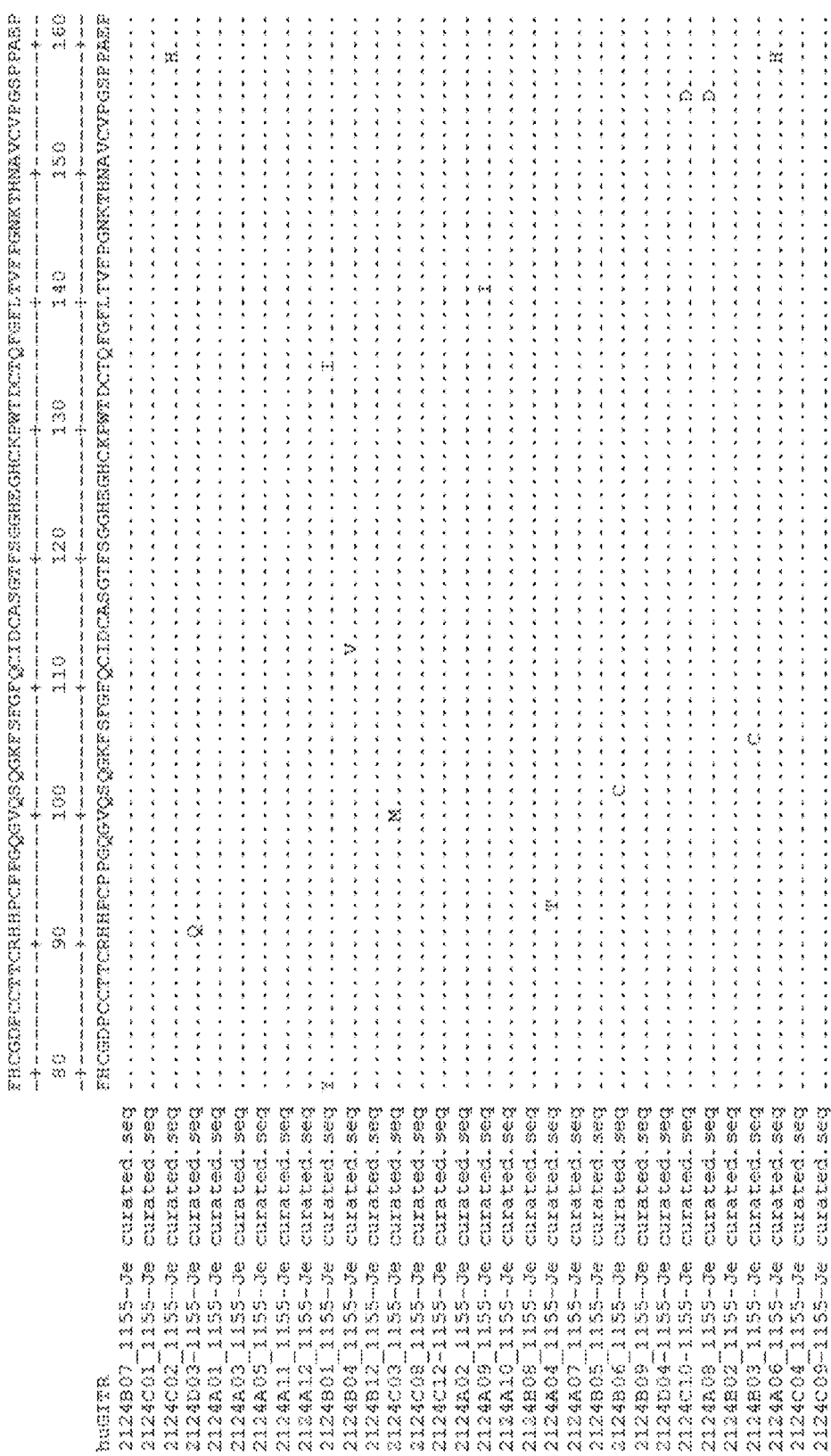

To connect phenotype (polyclonal anti-GITR+, chimeric parental 231-32-15-) with genotype, sequencing of single cell sorted huGITR variants was performed. FIG. 33 shows the alignment of sequences from these variants. The amino acid residues in FIG. 33 are numbered according to the immature amino acid sequence of human GITR (SEQ ID NO: 701). Sequencing identified regions with increased mutations or "hot spots" (e.g., P62 and G63), providing an indication of the epitope on human GITR recognized by anti-GITR chimeric parental 231-32-15 antibody.

To confirm the precise amino acids of human GITR involved in binding to anti-GITR antibodies, alanine replacement of hot spot amino acids was performed. The following positions (numbered according to SEQ ID NO: 701) were separately mutated to an Alanine: P28A, T29A, G30A, G31A, P32A, T54A, T55A, R56A, C57A, C58A, R59A, D60A, Y61A, P62A, G63A, E64A, E65A, C66A, C67A, S68A, E69A, W70A, D71A, C72A, M73A, C74A, V75A, and Q76A. Standard techniques of transfection followed by transduction were used to express these human GITR alanine mutants on the surface of 1624-5 cells.

Finally, alanine mutants expressed on 1624-5 cells were tested in flow cytometry (FACSCalibur; BD Biosciences) for the binding of the anti-GITR humanized variant Hum231#2, three germline variants (pab1967, pab1975 and pab1979) and the reference antibody m6C8. Briefly, 1624-5 cells expressing individual human GITR alanine mutants were incubated with 2 µg/ml of the monoclonal anti-GITR antibodies Hum231 #2, three germline variants (pab1967, pab1975 and pab1979), or the m6C8 antibody; or a polyclonal anti-GITR antibody (AF689, R&D systems) conjugated with APC, and Fc receptor block (1:200; BD Cat no. 553142) diluted in 100 µl FACS buffer (PBS+2% FCS) for 20 min at 4° C. After washing, the cells were incubated with a secondary anti-IgG antibody if necessary for detection (APC conjugated; BD Cat no. 109-136-097) diluted in 100 µl FACS buffer (PBS+2% FCS) for 20 min at 4° C. The cells were then washed and acquired using a flow cytometer (BD Biosciences). The mean fluorescence intensity (MFI) value of the tested monoclonal antibody was divided by the MFI value of the polyclonal antibody, generating an MFI ratio (monoclonal antibody/polyclonal antibody) for individual GITR alanine mutants. An average MFI ratio ("AMFI ratio") was calculated based on the individual MFI ratios for all the mutants. FIG. 34A is a table summarizing the binding of Hum231#2, three germline variants (pab1967, pab1975 and pab1979) and the reference antibody m6C8 to 1624-5 cells expressing human GITR alanine mutants. An individual MFI ratio that is above 60% of the AMFI ratio is considered to indicate similar binding, after normalization, of that of the polyclonal antibody and is represented by "+" in FIG. 34A. An individual MFI ratio that is between 30% and 60% of the AMFI ratio is represented by "+/−" in FIG. 34A. An individual MFI ratio that is below 30% of the AMFI ratio is represented by "−" in FIG. 34A.

As shown in FIG. 34A, the D60A mutant and the G63A mutant, numbered according to SEQ ID NO: 701, specifically disrupted or weakened the binding of the anti-GITR humanized variant Hum231#2 and the three germline variants (pab1967, pab1975 and pab1979), but not that of the reference antibody m6C8. The C58A mutant disrupted the binding of all five antibodies and is likely a structural mutation rather than an epitope-specific one. The C74A mutant had weak expression and could not be used for binding comparison.

Furthermore, the anti-GITR antibodies 231-32-15, Hum231#2, and m6C8 were compared for their binding to wild type versus mutant human GITR. Briefly, wild type human GITR and two GITR alanine mutants (the D60A mutant and the G63A mutant, numbered according to SEQ ID NO: 701) were expressed on the surface of 1624-5 cells as described above and tested in a flow cytometry analysis as described above where cells were first stained using 2 µg/ml of the monoclonal antibodies 231-32-15, Hum231#2, and m6C8, or a polyclonal antibody conjugated to APC, and then stained using a secondary anti-IgG antibody if necessary for detection (APC conjugated; 1:1000; BD Cat No. 109-136-097). All the mean fluorescence intensity (MFI) values were calculated as the mean of two measurements. The MFI value of the tested monoclonal antibody for a particular cell type was divided by the MFI value of the polyclonal antibody for the same cell type, generating a total of nine MFI ratios (monoclonal antibody/polyclonal antibody): MFI ratio$_{231\text{-}32\text{-}15,\ WT}$, MFI ratio$_{Hum231\#2,\ WT}$, MFI ratio$_{m6C8,\ WT}$, MFI ratio$_{231\text{-}32\text{-}15,\ D60A}$, MFI ratio$_{Hum231\#2,\ D60A}$, MFI ratio$_{m6C8,\ D60A}$, MFI ratio$_{231\text{-}32\text{-}15,\ G63A}$, MFI ratio$_{Hum231\#2,\ G63A}$, and MFI ratio$_{m6C8,\ G63A}$. The percentage of binding of an antibody to the GITR alanine mutants relative to the wild type GITR was calculated by dividing a particular MFI ratio for the GITR alanine mutants by the corresponding MFI ratio for the wild type (e.g., dividing MFI ratio$_{Hum231\#2,\ D60A}$ by MFI ratio$_{Hum231\#2,\ WT}$). The percentage of reduction in binding was determined by calculating, e.g., 100%*(1-(MFI ratio$_{Hum231\#2,\ D60A}$/MFI ratio$_{Hum231\#2,\ WT}$)).

Figure 34B:
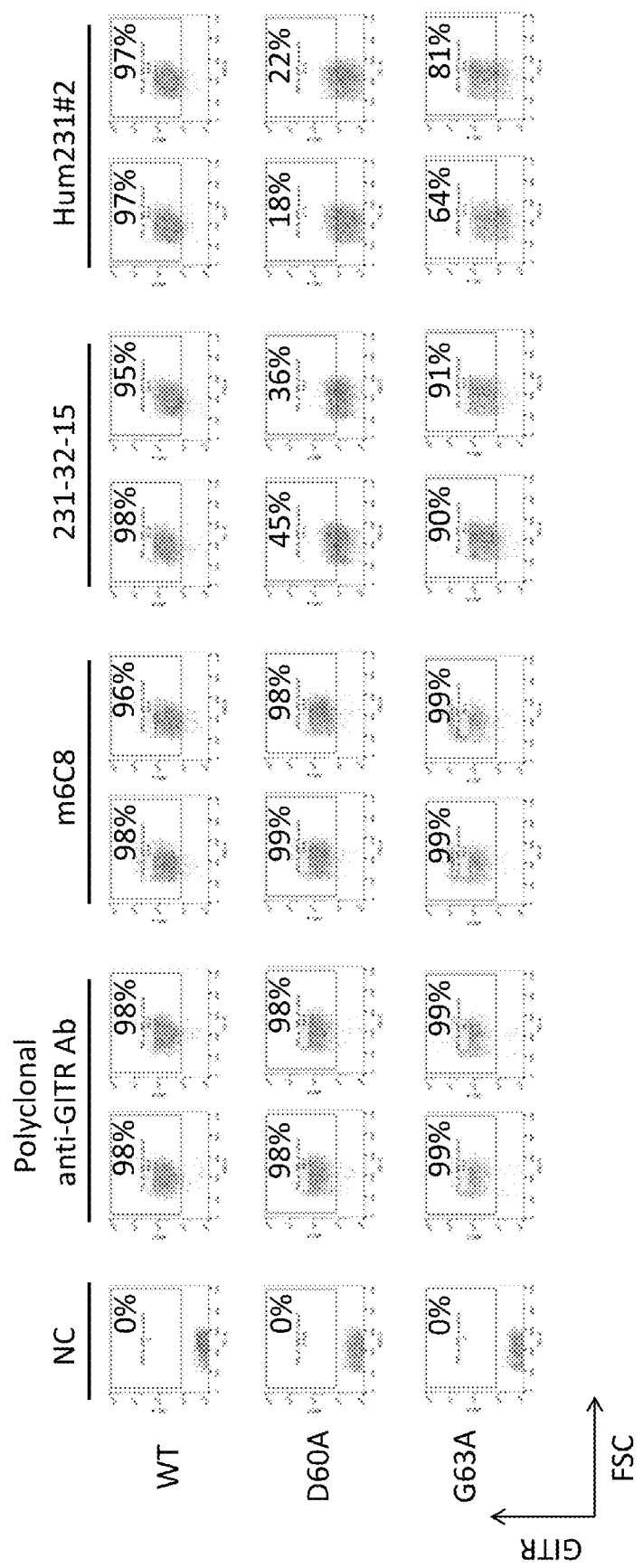

As shown in FIG. 34B, the D60A mutant and the G63A mutant specifically disrupted or weakened the binding of 231-32-15 and Hum231#2, but not that of m6C8. The percentages shown in FIG. 34B are the percentages of GITR positive cells in each plot. When tested using the cells expressing GITR D60A, antibody binding was reduced by 82% and 88% for 231-32-15 and Hum231#2, respectively, compared with a 10% reduction for m6C8. Similarly, when tested using the cells expressing GITR G63A, the binding of 231-32-15 and Hum231#2 was reduced by 37% and 59%, respectively, whereas the binding of m6C8 was increased by 62%.

As further evidence for the binding characteristics of the anti-GITR antibodies, the binding of the antibodies to cynomolgus GITR was compared. The immature protein of cynomolgus GITR comprises the amino acid sequence of SEQ ID NO: 704. To increase protein expression, the first residue of the signal peptide of cynomolgus GITR was replaced by methionine, generating V1M cynomolgus GITR. A mutant cynomolgus GITR V1M/Q62P/S63G, where the amino acid residues at the positions 62 and 63 (GlnSer), numbered according to SEQ ID NO: 704, were replaced by the corresponding residues in human GITR (ProGly), was then generated. FIG. 35A is a sequence alignment between human GITR, V1M cynomolgus GITR, and V1M/Q62P/S63G cynomolgus GITR. The three proteins shown in FIG. 35A were expressed on the surface of 1624-5 cells as described above and tested in a flow cytometry analysis as described above where cells were first stained using 2 μg/ml of the monoclonal antibodies 231-32-15, Hum231#2, and m6C8, or a polyclonal antibody conjugated to APC, and then stained using a secondary anti-IgG antibody (APC conjugated; 1:1000; BD Cat no. 109-136-097).

As shown in FIG. 35B, the anti-GITR antibodies 231-32-15 and Hum231#2 displayed binding only to the cells expressing V1M/Q62P/S63G cynomolgus GITR, but not the cells expressing V1M cynomolgus GITR.

6.7 Example 7: Treatment of T Cells In Vitro with Agonistic Anti-GITR Antibodies Followed by T Cell Infusion T cells expressing GITR, indicating an activated status, may be further activated to kill target cells, such as tumor cells, if cultured with a GITR agonistic antibody, e.g., Hum231#1, Hum231#2, Hum231#2w, or another GITR agonistic antibody described herein, prior to infusion into a subject, e.g., a human subject having cancer.

The expression level of GITR on T cells isolated from a subject, e.g., a human subject, is assessed by standard techniques, e.g., FACS analysis. The source of T cells is, e.g., peripheral blood, a biopsy/surgical specimen of a lymph node that drains the tumor site, or a biopsy/surgical specimen of the tumor itself in which T cells may have infiltrated. The T cells are isolated, e.g., from total PBMCs, lymph tissue or tumor tissue by standard techniques. If GITR is observed to be expressed on the T cell surface, the cells may be incubated with a GITR agonistic antibody, e.g., Hum231#1, Hum231#2, Hum231#2w, or another GITR agonist antibody described herein, at concentrations ranging from, e.g., 1 μg/ml to 1 mg/ml, for, e.g., 30 minutes, 1 hour, 2 hours, 3 hours, 4 hours, 6, hours, 12 hours, 24 hours, 36 hours, 48 hours, or 72 hours, followed by, e.g., intravenous infusion of the T cells into a subject.

If GITR is not observed to be expressed on T cells isolated from a subject, its expression may be induced by co-incubation of the T cells with a TCR complex stimulating agent, such as e.g., phytohaemagglutinin (PHA) and/or phorbol myristate acetate (PMA), or a TCR complex stimulating antibody, such as an anti-CD3 antibody and anti-CD28 antibody, (at concentrations ranging from, e.g., 1 μg/ml to 1 mg/ml, for, e.g., 30 minutes, 1 hour, 2 hours, 3 hours, 4 hours, 6, hours, 12 hours, 24 hours, 36 hours, 48 hours, or 72 hours). Alternatively, it may be preferable to first incubate T cells with an anti-CD3 antibody alone followed by addition of the agonistic GITR antibody 30 mins, 1 hour, 2 hours, 3 hours, 4 hours, 6 hours, 12 hours, 24 hours, 36 hours, 48 hours, or 72 hours later. It may also be desirable to stimulate T cells with a tumor antigen, e.g., in the form of peptides or proteins, in the presence of antigen presenting cells in order to activate and expand the number of tumor-specific T cells. Subsequent to antigen stimulation, the T cells may be cultured with a GITR agonistic antibody to enhance their activation status prior to infusion.

The T cells may be infused into the subject over a period of, e.g., 30 minutes, 1 hour, 2 hours, 3 hours, 4 hours, 6, hours, 12 hours, or 24 hours, and may be infused into the subject one, two, three, four, or more times, e.g., separated by 1, 2, 3, or 4 weeks, or 1, 2, 3, 4, 5, or 6 months. The number of T cells infused may be determined by standard experimental methods and may include, e.g., $1 \times 10^6$ cells, $1 \times 10^7$ cells, $1 \times 10^8$ cells, $1 \times 10^9$ cells or more.

In some embodiments, the T cells may be contacted with an agent such as a mitogen (e.g., PHA) or a cytokine (e.g., IL-2) to non-specifically expand the T cell population prior to, during, or subsequent to treatment with GITR agonistic antibody.

In some embodiments, the T cells may be contacted with a further agonist in addition to the GITR agonistic antibody, e.g., an OX40 agonistic antibody.

The invention is not to be limited in scope by the specific embodiments described herein. Indeed, various modifications of the invention in addition to those described will become apparent to those skilled in the art from the foregoing description and accompanying figures. Such modifications are intended to fall within the scope of the appended claims.

All references (e.g., publications or patents or patent applications) cited herein are incorporated herein by reference in their entirety and for all purposes to the same extent as if each individual reference (e.g., publication or patent or patent application) was specifically and individually indicated to be incorporated by reference in its entirety for all purposes. Other embodiments are within the following claims.

SEQUENCE LISTING (1118 sequences)

SEQ ID NO: 1 - protein, 5 aa, Artificial Sequence
  HCDR1 library consensus
  MISC_FEATURE (1)..(1): can be Aspartic Acid, Glutamic Acid, Glycine, or Alanine
  MISC_FEATURE (3)..(3): can be Alanine, Valine, Leucine, Isoleucine, Proline, Phenylalanine, Methionine, or Tyrosine
  MISC_FEATURE (5)..(5): can be Tyrosine, Glycine, Asparagine, Glutamine, Serine, Threonine, Cysteine, Tryptophan, Phenylalanine, or Histidine
XYXMX

SEQ ID NO: 2 - protein, 17 aa, Artificial Sequence
  HCDR2 library consensus
  MISC_FEATURE (1)..(1): can be Valine, Alanine, Leucine, Isoleucine, Proline, Phenylalanine, Methionine, or Threonine
  MISC_FEATURE (3)..(3): can be Arginine, Lysine, Histidine, Glutamine, or Alanine
  MISC_FEATURE (4)..(4): can be Threonine, Glycine, Asparagine, Glutamine, Serine, Cysteine, Tryptophan, Tyrosine, Valine, Isoleucine or Proline
  MISC_FEATURE (5)..(5): can be Tyrosine, Glycine, Asparagine, Glutamine, Serine, Threonine, Cysteine, Tryptophan, Phenylalanine, Histidine or Alanine
  MISC_FEATURE (8)..(8): can be Aspartic Acid, Glutamic Acid, Glycine, or Alanine
  MISC_FEATURE (9)..(9): can be Valine, Alanine, Leucine, Isoleucine, Proline, Phenylalanine, Methionine, Threonine
  MISC_FEATURE (10)..(10): can be Threonine, Glycine, Asparagine, Glutamine, Serine, Cysteine, Tryptophan, Tyrosine, Valine, Isoleucine, Proline, or Alanine
  MISC_FEATURE (12)..(12): can be Asparagine, Glycine, Glutamine, Serine, Threonine, Cysteine, Tryptophan, Tyrosine or Alanine
  MISC_FEATURE (16)..(16): can be Lysine, Arginine, Histidine, Glutamine, or Alanine
  MISC_FEATURE (17)..(17): can be Aspartic Acid, Glutamic Acid, Glycine, or Alanine
XIXXXSGXXXYXQKFXX

SEQ ID NO: 3 - protein, 9 aa, Artificial Sequence
  HCDR3 library consensus
  MISC_FEATURE (7)..(7): can be Phenylalanine, Alanine, Valine, Leucine, Isoleucine, Proline, Methionine, Tyrosine, Tryptophan, Histidine or Serine
  MISC_FEATURE (8)..(8): can be Alanine or Aspartic Acid
  MISC_FEATURE (9)..(9): can be Tyrosine, Glycine, Asparagine, Glutamine, Serine, Threonine, Cysteine, Tryptophan, Phenylalanine, Histidine, or Valine
SGTVRGXXX

SEQ ID NO: 4 - protein, 17 aa, Artificial Sequence
  LCDR1 library consensus
  MISC_FEATURE (6)..(6): can be Leucine, Alanine, Valine, Isoleucine, Proline, Phenylalanine or Methionine
  MISC_FEATURE (7)..(7): can be Leucine, Alanine, Valine, Isoleucine, Proline, Phenylalanine, Methionine, or Serine
  MISC_FEATURE (8)..(8): can be Asparagine, Glycine, Glutamine, Serine, Threonine, Cysteine, Tryptophan, Tyrosine, or Alanine
  MISC_FEATURE (9)..(9): can be Serine, Glycine, Asparagine, Glutamine, Threonine, Cysteine, Tryptophan, Tyrosine, or Alanine
  MISC_FEATURE (10)..(10): can be Glycine, Asparagine, Glutamine, Serine, Threonine, Cysteine, Tryptophan, Tyrosine, or Alanine
  MISC_FEATURE (11)..(11): can be Asparagine, Glycine, Glutamine, Serine, Threonine, Cysteine, Tryptophan, Tyrosine, or Alanine
  MISC_FEATURE (12)..(12): can be Glutamine, Glycine, Asparagine, Serine, Threonine, Cysteine, Tryptophan, Tyrosine, or Alanine
  MISC_FEATURE (14)..(14): can be Asparagine, Glycine, Glutamine, Serine, Threonine, Cysteine, Tryptophan, Tyrosine, or Alanine
  MISC_FEATURE (17)..(17): can be Threonine, Glycine, Asparagine, Glutamine, Serine, Cysteine, Tryptophan, Tyrosine, Valine, Isoleucine or Alanine
KSSQSXXXXXXXKXYLX

SEQ ID NO: 5 - protein, 7 aa, Artificial Sequence
  LCDR2 library consensus
  MISC_FEATURE (1)..(1): can be Tryptophan, Glycine, Asparagine, Glutamine, Serine, Threonine, Cysteine, Tyrosine, Phenylalanine, Histidine, or Alanine
  MISC_FEATURE (6)..(6): can be Glutamic Acid, Aspartic Acid, or Alanine
  MISC_FEATURE (7)..(7): can be Serine, Glycine, Asparagine, Glutamine, Threonine, Cysteine, Tryptophan, Tyrosine or Alanine
XASTRXX

SEQ ID NO: 6 - protein, 9 aa, Artificial Sequence
  LCDR3 library consensus
  MISC_FEATURE (2)..(2): can be Asparagine, Glycine, Glutamine, Serine, Threonine, Cysteine, Tryptophan, or Tyrosine
  MISC_FEATURE (3)..(3): can be Aspartic Acid, Glutamic Acid, or Tyrosine
  MISC_FEATURE (5)..(5): can be Serine, Glycine, Asparagine, Glutamine, Threonine, Cysteine, Tryptophan, Tyrosine, or Alanine
  MISC_FEATURE (6)..(6): can be Tyrosine, Glycine, Asparagine, Glutamine, Serine, Threonine, Cysteine, Tryptophan, Phenylalanine, Histidine, Leucine, or Alanaine
QXXYXXPYT

SEQ ID NO: 7 - protein, 5 aa, Artificial Sequence
  HCDR1 library consensus
  MISC_FEATURE (1)..(1): can be Aspartic Acid, Glutamic Acid, or Glycine
  MISC_FEATURE (3)..(3): can be Alanine or Valine
  MISC_FEATURE (5)..(5): can be Tyrosine or Histidine
XYXMX

SEQ ID NO: 8 - protein, 17 aa, Artificial Sequence
  HCDR2 library consensus
  MISC_FEATURE (1)..(1): can be Valine or Leucine
  MISC_FEATURE (3)..(3): can be Arginine, Lysine, or Glutamine
  MISC_FEATURE (5)..(5): can be Tyrosine or Phenylalanine
  MISC_FEATURE (8)..(8): can be Aspartic Acid, Glutamic Acid, or Glycine
  MISC_FEATURE (9)..(9): can be Valine or Leucine
  MISC_FEATURE (10)..(10): can be Threonine or Serine
  MISC_FEATURE (16)..(16): can be Lysine, Arginine, or Glutamine
  MISC_FEATURE (17)..(17): can be Aspartic Acid, Glutamic Acid, or Glycine
XIXTXSGXXXYNQKFXX

SEQ ID NO: 9 - protein, 9 aa, Artificial Sequence
  HCDR3 library consensus
SGTVRGFAY

SEQ ID NO: 10 - protein, 17 aa, Artificial Sequence
  LCDR1 library consensus
  MISC_FEATURE (10)..(10): can be Glycine or Serine
  MISC_FEATURE (17)..(17): can be Threonine or Serine
KSSQSLLNSXNQKNYLX

SEQ ID NO: 11 - protein, 7 aa, Artificial Sequence
  LCDR2 library consensus
WASTRES

SEQ ID NO: 12 - protein, 9 aa, Artificial Sequence
  LCDR3 library consensus
  MISC_FEATURE (3)..(3): can be Aspartic Acid or Glutamic Acid
  MISC_FEATURE (6)..(6): can be Tyrosine, Phenylalanine or Serine
QNXYSXPYT

SEQ ID NO: 13 - protein, 5 aa, Artificial Sequence
  HCDR1
DYAMY

SEQ ID NO: 14 - protein, 17 aa, Artificial Sequence
  HCDR2
VIRTYSGDVTYNQKFKD

SEQ ID NO: 15 - protein, 9 aa, Artificial Sequence
  HCDR3
SGTVRGFAY

SEQ ID NO: 16 - protein, 17 aa, Artificial Sequence
  LCDR1
KSSQSLLNSGNQKNYLT

SEQ ID NO: 17 - protein, 7 aa, Artificial Sequence
  LCDR2
WASTRES

SEQ ID NO: 18 - protein, 9 aa, Artificial Sequence
  LCDR3
QNDYSYPYT

SEQ ID NO: 19 - protein, 5 aa, Artificial Sequence
  HCDR1 from GL variants
GYAMY

SEQ ID NO: 20 - protein, 5 aa, Artificial Sequence
  HCDR1 from GL variants
GYAMH

SEQ ID NO: 21 - protein, 5 aa, Artificial Sequence
  HCDR1 from GL variants
DYAMY

SEQ ID NO: 22 - protein, 5 aa, Artificial Sequence
  HCDR1 from GL variants
EYAMH

SEQ ID NO: 23 - protein, 5 aa, Artificial Sequence
  HCDR1 from GL variants
EYAMY

SEQ ID NO: 24 - protein, 17 aa, Artificial Sequence
  HCDR2 from GL variants
LIRTYSGGVTYNQKFQG

SEQ ID NO: 25 - protein, 17 aa, Artificial Sequence
  HCDR2 from GL variants
VIRTFSGDVTYNQKFRG

SEQ ID NO: 26 - protein, 17 aa, Artificial Sequence
  HCDR2 from GL variants
VIKTYSGGVTYNQKFRG

SEQ ID NO: 27 - protein, 17 aa, Artificial Sequence
  HCDR2 from GL variants
LIRTYSGGVSYNQKFRE

SEQ ID NO: 28 - protein, 17 aa, Artificial Sequence
  HCDR2 from GL variants
VIRTFSGDLTYNQKFQD

SEQ ID NO: 29 - protein, 17 aa, Artificial Sequence
  HCDR2 from GL variants
LIRTYSGGVSYNQKFQG

SEQ ID NO: 30 - protein, 17 aa, Artificial Sequence
  HCDR2 from GL variants
VIRTYSGDVDYNQKFRG

SEQ ID NO: 31 - protein, 17 aa, Artificial Sequence
  HCDR2 from GL variants
LIRTYSGGVSYNQKFRD

SEQ ID NO: 32 - protein, 17 aa, Artificial Sequence
  HCDR2 from GL variants
VIRTFSGGVTYNQKFRG

SEQ ID NO: 33 - protein, 17 aa, Artificial Sequence
  HCDR2 from GL variants
VIRTYSGGVSYNQKFQE

SEQ ID NO: 34 - protein, 9 aa, Artificial Sequence
  HCDR3 from GL variants
SGTVRGFAY

SEQ ID NO: 35 - protein, 5 aa, Artificial Sequence
  HCDR1 from GL variants
DYVMY

SEQ ID NO: 36 - protein, 6 aa, Artificial Sequence
  6xHis tag
HHHHHH

SEQ ID NO: 37 - protein, 28 aa, Artificial Sequence
  hum231-32-15VH
AGDYAMYLIVIRTYSGDVTYNQKFKDAK

SEQ ID NO: 38 - protein, 28 aa, Artificial Sequence
  Design of ML38
  MISC_FEATURE (1)..(1): can be Ala or Thr
  MISC_FEATURE (2)..(2): can be Gly or Ala
  MISC_FEATURE (3)..(3): can be Asp, Glu or Gly
  MISC_FEATURE (5)..(5): can be Ala or Val
  MISC_FEATURE (7)..(7): can be Tyr or His
  MISC_FEATURE (8)..(8): can be Leu or Met
  MISC_FEATURE (9)..(9): can be Ile or Met
  MISC_FEATURE (10)..(10): can be Val or Leu
  MISC_FEATURE (12)..(12): can be Arg, Lys or Gln
  MISC_FEATURE (14)..(14): can be Tyr or Phe
  MISC_FEATURE (17)..(17): can be Asp, Glu or Gly
  MISC_FEATURE (18)..(18): can be Val or Leu
  MISC_FEATURE (19)..(19): can be Thr or Ser
  MISC_FEATURE (25)..(25): can be Lys, Arg or Gln
  MISC_FEATURE (26)..(26): can be Asp, Glu or Gly
  MISC_FEATURE (27)..(27): can be Ala or Val
  MISC_FEATURE (28)..(28): can be Lys or Thr
XXXYXMXXXXIXTXSGXXXYNQKFXXXX

SEQ ID NO: 39 - protein, 28 aa, Artificial Sequence
  D03
AAGYAMYMILIRTYSGGVTYNQKFQGVT

SEQ ID NO: 40 - protein, 28 aa, Artificial Sequence
  D05
AGGYAMYMIVIRTFSGDVTYNQKFRGVT

SEQ ID NO: 41 - protein, 28 aa, Artificial Sequence
  D07
TGEYAMYMILIRTFSGEVTYNQKFKDVT

SEQ ID NO: 42 - protein, 28 aa, Artificial Sequence
  D08
TGGYAMYLIVIKTYSGGVTYNQKFRGVK

SEQ ID NO: 43 - protein, 28 aa, Artificial Sequence
  D09
AGGYAMHLMLIRTYSGGVSYNQKFREAT

SEQ ID NO: 44 - protein, 28 aa, Artificial Sequence
  E01
TADYAMYLIVIRTFSGDLTYNQKFQDVT

SEQ ID NO: 45 - protein, 28 aa, Artificial Sequence
  F09
AAEYAMHLMLIRTYSGGVSYNQKFQGAT

SEQ ID NO: 46 - protein, 28 aa, Artificial Sequence
  F10
TADYAMYLILIRTYSGGVTYNQKFQGVT

SEQ ID NO: 47 - protein, 28 aa, Artificial Sequence
  G01
TGDYAMYMMVIRTYSGDVSYNQKFRGVT

SEQ ID NO: 48 - protein, 28 aa, Artificial Sequence
  G05
AAEYAMYLMLIRTYSGGVSYNQKFRDVK

SEQ ID NO: 49 - protein, 28 aa, Artificial Sequence
  B07
AAGYAMYMMVIRTFSGGVTYNQKFRGAT

SEQ ID NO: 50 - protein, 28 aa, Artificial Sequence
  C03
TGDYAMYMIVIKTYSGGVTYNQKFKDAT

SEQ ID NO: 51 - protein, 28 aa, Artificial Sequence
  F07
TGDYAMYLIVIRTFSGEVTYNQKFQEVA

SEQ ID NO: 52 - protein, 28 aa, Artificial Sequence
  D11
TAEYAMYMIVIRTFSGGVTYNQKFQEVK

SEQ ID NO: 53 - protein, 28 aa, Artificial Sequence
  Variant F08
AAEYAMHLMVIRTYSGGVSYNQKFQEVT

SEQ ID NO: 54 - protein, 42 aa, Artificial Sequence
  hum231-32-15VK
KSSQSLLNSGNQKNYLTWQQLWASTRESSGLQHQNDYSYPYT

SEQ ID NO: 55 - protein, 42 aa, Artificial Sequence
  Design of ML39
  MISC_FEATURE (10)..(10): Gly or Ser
  MISC_FEATURE (17)..(17): Thr or Ser
  MISC_FEATURE (19)..(19): Gln or His
  MISC_FEATURE (21)..(21): Leu or Met
  MISC_FEATURE (29)..(29): Ser or Thr
  MISC_FEATURE (31)..(31): Leu or Val
  MISC_FEATURE (33)..(33): His or Tyr
  MISC_FEATURE (36)..(36): Asp or Glu
  MISC_FEATURE (39)..(39): Tyr, Phe or Ser
KSSQSLLNSXNQKNYLXWXQXWASTRESXGXQXQNXYSXPYT

SEQ ID NO: 56 - protein, 42 aa, Artificial Sequence
  D03
KSSQSLLNSGNQKNYLSWHQLWASTRESSGVQHQNEYSYPYT

SEQ ID NO: 57 - protein, 42 aa, Artificial Sequence
  D05
KSSQSLLNSGNQKNYLTWHQLWASTRESTGVQYQNDYSYPYT

SEQ ID NO: 58 - protein, 42 aa, Artificial Sequence
  D07
KSSQSLLNSGNQKNYLTWQQLWASTRESTGLQHQNEYSYPYT

SEQ ID NO: 59 - protein, 42 aa, Artificial Sequence
  D08
KSSQSLLNSGNQKNYLTWQQLWASTRESSGLQYQNDYSYPYT

SEQ ID NO: 60 - protein, 42 aa, Artificial Sequence
  D09
KSSQSLLNSSNQKNYLTWQQLWASTRESTGVQHQNEYSFPYT

SEQ ID NO: 61 - protein, 42 aa, Artificial Sequence
  E01
KSSQSLLNSGNQKNYLSWQQLWASTRESSGLQYQNDYSYPYT

SEQ ID NO: 62 - protein, 42 aa, Artificial Sequence
  F09
KSSQSLLNSSNQKNYLTWQQLWASTRESTGVQHQNDYSFPYT

SEQ ID NO: 63 - protein, 42 aa, Artificial Sequence
  F10
KSSQSLLNSGNQKNYLSWQQLWASTRESSGVQHQNDYSFPYT

SEQ ID NO: 64 - protein, 42 aa, Artificial Sequence
  G05
KSSQSLLNSSNQKNYLSWHQLWASTRESSGVQHQNDYSYPYT

SEQ ID NO: 65 - protein, 42 aa, Artificial Sequence
  n/a
KSSQSLLNSSNQKNYLTWQQLWASTRESTGVQHQNDYSYPYT

SEQ ID NO: 66 - protein, 42 aa, Artificial Sequence
  G09
KSSQSLLNSGNQKNYLSWHQLWASTRESTGVQHQNDYSYPYT

SEQ ID NO: 67 - protein, 42 aa, Artificial Sequence
  C11
KSSQSLLNSSNQKNYLSWQQLWASTRESSGLQHQNDYSYPYT

SEQ ID NO: 68 - protein, 42 aa, Artificial Sequence
  F02
KSSQSLLNSSNQKNYLTWQQLWASTRESTGLQYQNDYSYPYT

SEQ ID NO: 69 - protein, 42 aa, Artificial Sequence
  F03
KSSQSLLNSSNQKNYLTWQQMWASTRESSGLQYQNDYSYPYT

SEQ ID NO: 70 - protein, 42 aa, Artificial Sequence
  D07
KSSQSLLNSSNQKNYLTWQQLWASTRESTGLQYQNDYSFPYT

SEQ ID NO: 71 - protein, 42 aa, Artificial Sequence
  Variant F05
KSSQSLLNSGNQKNYLTWQQLWASTRESSGLQHQNDYSFPYT

SEQ ID NO: 72 - protein, 4 aa, Artificial Sequence
  Epitope
DYPG

SEQ ID NO: 73-100 - skipped (28 entries)

SEQ ID NO: 101 - protein, 17 aa, Artificial Sequence
  LCDR1 from GL variants
KSSQSLLNSGNQKNYLS

SEQ ID NO: 102 - protein, 17 aa, Artificial Sequence
  LCDR1 from GL variants
KSSQSLLNSGNQKNYLT

SEQ ID NO: 103 - protein, 17 aa, Artificial Sequence
  LCDR1 from GL variants
KSSQSLLNSSNQKNYLT

SEQ ID NO: 104 - protein, 17 aa, Artificial Sequence
  LCDR1 from GL variants
KSSQSLLNSSNQKNYLS

SEQ ID NO: 105 - protein, 7 aa, Artificial Sequence
  LCDR2 from GL variants
WASTRES

SEQ ID NO: 106 - protein, 9 aa, Artificial Sequence
  LCDR3 from GL variants
QNEYSYPYT

SEQ ID NO: 107 - protein, 9 aa, Artificial Sequence
  LCDR3 from GL variants
QNDYSYPYT

SEQ ID NO: 108 - protein, 9 aa, Artificial Sequence
  LCDR3 from GL variants
QNEYSFPYT

SEQ ID NO: 109 - protein, 9 aa, Artificial Sequence
  LCDR3 from GL variants
QNDYSFPYT

SEQ ID NO: 110-113 - skipped (4 entries)

SEQ ID NO: 114 - protein, 17 aa, Artificial Sequence
  HCDR2
VIRTFSGDLSYNQKFRG

SEQ ID NO: 115 - protein, 17 aa, Artificial Sequence
  HCDR2
LIRTYSGGVSYNQKFQE

SEQ ID NO: 116 - protein, 5 aa, Artificial Sequence
  HCDR1
GYVMY

SEQ ID NO: 117 - protein, 5 aa, Artificial Sequence
  HCDR1
DYAMH

SEQ ID NO: 118 - protein, 5 aa, Artificial Sequence
  HCDR1
EYVMH

SEQ ID NO: 119 - protein, 5 aa, Artificial Sequence
  HCDR1
GYVMH

SEQ ID NO: 120 - protein, 17 aa, Artificial Sequence
  HCDR2
IIKTYSGGVSYNQKFQG

SEQ ID NO: 121 - protein, 17 aa, Artificial Sequence
  HCDR2
LIQTYSGDVSYNQKFRG

SEQ ID NO: 122 - protein, 17 aa, Artificial Sequence
  HCDR2
LIRTFSGDLSYNQKFRG

SEQ ID NO: 123 - protein, 17 aa, Artificial Sequence
  HCDR2
LIRTFSGDVSYNQKFKG

SEQ ID NO: 124 - protein, 17 aa, Artificial Sequence
  HCDR2
LIRTFSGDVSYNQKFQD

SEQ ID NO: 125 - protein, 17 aa, Artificial Sequence
  HCDR2
LIRTFSGDVSYNQKFRE

SEQ ID NO: 126 - protein, 17 aa, Artificial Sequence
  HCDR2
LIRTFSGDVSYNQKFRG

SEQ ID NO: 127 - protein, 17 aa, Artificial Sequence
  HCDR2
LIRTFSGDVTYNQKFRG

SEQ ID NO: 128 - protein, 17 aa, Artificial Sequence
  HCDR2
LIRTFSGEVSYNQKFQD

SEQ ID NO: 129 - protein, 17 aa, Artificial Sequence
  HCDR2
LIRTFSGEVTYNQKFKD

SEQ ID NO: 130 - protein, 17 aa, Artificial Sequence
  HCDR2
LIRTFSGEVTYNQKFRG

SEQ ID NO: 131 - protein, 17 aa, Artificial Sequence
  HCDR2
LIRTFSGGLSYNQKFRD

SEQ ID NO: 132 - protein, 17 aa, Artificial Sequence
  HCDR2
LIRTFSGGLSYNQKFRE

SEQ ID NO: 133 - protein, 17 aa, Artificial Sequence
  HCDR2
LIRTFSGGLTYNQKFKD

SEQ ID NO: 134 - protein, 17 aa, Artificial Sequence
  HCDR2
LIRTFSGGVSYNQKFKE

SEQ ID NO: 135 - protein, 17 aa, Artificial Sequence
  HCDR2
LIRTFSGGVSYNQKFKG

SEQ ID NO: 136 - protein, 17 aa, Artificial Sequence
  HCDR2
LIRTFSGGVSYNQKFQD

SEQ ID NO: 137 - protein, 17 aa, Artificial Sequence
  HCDR2
LIRTFSGGVSYNQKFRD

SEQ ID NO: 138 - protein, 17 aa, Artificial Sequence
  HCDR2
LIRTFSGGVSYNQKFRG

SEQ ID NO: 139 - protein, 17 aa, Artificial Sequence
  HCDR2
LIRTFSGGVTYNQKFQG

SEQ ID NO: 140 - protein, 17 aa, Artificial Sequence
  HCDR2
LIRTFSGGVTYNQKFRE

SEQ ID NO: 141 - protein, 17 aa, Artificial Sequence
  HCDR2
LIRTYSGDLSYNQKFKE

SEQ ID NO: 142 - protein, 17 aa, Artificial Sequence
  HCDR2
LIRTYSGDVSYNQKFQG

SEQ ID NO: 143 - protein, 17 aa, Artificial Sequence
  HCDR2
LIRTYSGDVTYNQKFKD

SEQ ID NO: 144 - protein, 17 aa, Artificial Sequence
  HCDR2
LIRTYSGEVSYNQKFRG

SEQ ID NO: 145 - protein, 17 aa, Artificial Sequence
  HCDR2
LIRTYSGGLSYNQKFQD

SEQ ID NO: 146 - protein, 17 aa, Artificial Sequence
  HCDR2
LIRTYSGDVSYNQKFRD

SEQ ID NO: 147 - protein, 17 aa, Artificial Sequence
  HCDR2
LIRTYSGGVSYNQKFQG

SEQ ID NO: 148 - protein, 17 aa, Artificial Sequence
  HCDR2
LIRTYSGGVSYNQKFRG

SEQ ID NO: 149 - protein, 17 aa, Artificial Sequence
  HCDR2
LIRTYSGGVTYNQKFKE

SEQ ID NO: 150 - protein, 17 aa, Artificial Sequence
  HCDR2
LIRTYSGGVTYNQKFRE

SEQ ID NO: 151 - protein, 17 aa, Artificial Sequence
  HCDR2
LIRTYSGGVTYNQKFRG

SEQ ID NO: 152 - protein, 17 aa, Artificial Sequence
  HCDR2
VIKTFSGGVSYNQKFQE

SEQ ID NO: 153 - protein, 17 aa, Artificial Sequence
  HCDR2
VIKTYSGGVSYNQKFRG

SEQ ID NO: 154 - protein, 17 aa, Artificial Sequence
  HCDR2
VIKTYSGGVTYNQKFKD

SEQ ID NO: 155 - protein, 17 aa, Artificial Sequence
  HCDR2
VIKTYSGGVTYNQKFRD

SEQ ID NO: 156 - protein, 17 aa, Artificial Sequence
  HCDR2
VIQTFSGDVSYNQKFKG

SEQ ID NO: 157 - protein, 17 aa, Artificial Sequence
  HCDR2
VIQTFSGGVTYNQKFRG

SEQ ID NO: 158 - protein, 17 aa, Artificial Sequence
  HCDR2
VIQTYSGDVSYNQKFQG

SEQ ID NO: 159 - protein, 17 aa, Artificial Sequence
  HCDR2
VIRTFSGDLSYNQKFKG

SEQ ID NO: 160 - protein, 17 aa, Artificial Sequence
  HCDR2
VIRTFSGDVSYNQKFQE

SEQ ID NO: 161 - protein, 17 aa, Artificial Sequence
  HCDR2
VIRTFSGDVSYNQKFRD

SEQ ID NO: 162 - protein, 17 aa, Artificial Sequence
  HCDR2
VIRTFSGDVSYNQKFRE

SEQ ID NO: 163 - protein, 17 aa, Artificial Sequence
  HCDR2
VIRTFSGDVTYNQKFKG

SEQ ID NO: 164 - protein, 17 aa, Artificial Sequence
  HCDR2
VIRTFSGEVSYNQKFKG

SEQ ID NO: 165 - protein, 17 aa, Artificial Sequence
  HCDR2
VIRTFSGGLSYNQKFRG

SEQ ID NO: 166 - protein, 17 aa, Artificial Sequence
  HCDR2
VIRTFSGGVSYNQKFQE

SEQ ID NO: 167 - protein, 17 aa, Artificial Sequence
  HCDR2
VIRTFSGGVSYNQKFQG

SEQ ID NO: 168 - protein, 17 aa, Artificial Sequence
  HCDR2
VIRTFSGGVSYNQKFRD

SEQ ID NO: 169 - protein, 17 aa, Artificial Sequence
  HCDR2
VIRTFSGGVSYNQKFRE

SEQ ID NO: 170 - protein, 17 aa, Artificial Sequence
  HCDR2
VIRTFSGGVSYNQKFRG

SEQ ID NO: 171 - protein, 17 aa, Artificial Sequence
  HCDR2
VIRTFSGGVTYNQKFKD

SEQ ID NO: 172 - protein, 17 aa, Artificial Sequence
  HCDR2
VIRTFSGGVTYNQKFKG

SEQ ID NO: 173 - protein, 17 aa, Artificial Sequence
  HCDR2
VIRTFSGGVTYNQKFRD

SEQ ID NO: 174 - protein, 17 aa, Artificial Sequence
  HCDR2
VIRTYSGDLSYNQKFRG

SEQ ID NO: 175 - protein, 17 aa, Artificial Sequence
  HCDR2
VIRTYSGDVSYNQKFQE

SEQ ID NO: 176 - protein, 17 aa, Artificial Sequence
  HCDR2
VIRTYSGDVSYNQKFRD

SEQ ID NO: 177 - protein, 17 aa, Artificial Sequence
  HCDR2
VIRTYSGDVSYNQKFRG

SEQ ID NO: 178 - protein, 17 aa, Artificial Sequence
  HCDR2
VIRTYSGDVTYNQKFKD

SEQ ID NO: 179 - protein, 17 aa, Artificial Sequence
  HCDR2
VIRTYSGDVTYNQKFRE

SEQ ID NO: 180 - protein, 17 aa, Artificial Sequence
  HCDR2
VIRTYSGDVTYNQKFRG

SEQ ID NO: 181 - protein, 17 aa, Artificial Sequence
  HCDR2
VIRTYSGEVSYNQKFQE

SEQ ID NO: 182 - protein, 17 aa, Artificial Sequence
  HCDR2
VIRTYSGGLSYNQKFRG

SEQ ID NO: 183 - protein, 17 aa, Artificial Sequence
  HCDR2
VIRTYSGEVSYNQKFRG

SEQ ID NO: 184 - protein, 17 aa, Artificial Sequence
  HCDR2
VIRTYSGGLTYNQKFRD

SEQ ID NO: 185 - protein, 17 aa, Artificial Sequence
  HCDR2
VIRTYSGGVTYNQKFKD

SEQ ID NO: 186 - protein, 17 aa, Artificial Sequence
  HCDR2
VIRTYSGGVTYNQKFKG

SEQ ID NO: 187 - protein, 17 aa, Artificial Sequence
  HCDR2
VIRTYSGGVTYNQKFQG

SEQ ID NO: 188 - protein, 17 aa, Artificial Sequence
  HCDR2
VIRTYSGGVTYNQKFRD

SEQ ID NO: 189 - protein, 9 aa, Artificial Sequence
  HCDR3
SGTVRGFAD

SEQ ID NO: 190 - skipped

SEQ ID NO: 191 - protein, 9 aa, Artificial Sequence
  LCDR3
QNDHSFPYT

SEQ ID NO: 192 - protein, 9 aa, Artificial Sequence
  LCDR3
QNDYSSPYT

SEQ ID NO: 193 - protein, 9 aa, Artificial Sequence
  LCDR3
QNEYSSPYT

SEQ ID NO: 194 - protein, 17 aa, Artificial Sequence
  HCDR2
VIRTYSGGVSYNQKFRD

SEQ ID NO: 195-200 - skipped (6 entries)

SEQ ID NO: 201 - protein, 118 aa, Artificial Sequence
  Mouse VH
QVQLLQSGTELVRPGVSVKISCKGSGYTFTDYAMYWVKQSHAKSLEWIGVIRTYSGDVTYNQKFKDKATMTVDKSSSIAYMELARLSSEDSAIYYCAKSGTVRGFAYWGQGTLVTVSS

SEQ ID NO: 202 - protein, 113 aa, Artificial Sequence
  Mouse VL
DIVMTQSPSSLTVTAGEKVIMSCKSSQSLLNSGNQKNYLTWYQQKPGQPPKLLIYWASTRESGVPDRFTGSGSGTDFTLTISSVQAEDLAVYHCQNDYSYPYTFGGGTKLEIK

SEQ ID NO: 203 - protein, 118 aa, Artificial Sequence
  Humanized VH consensus sequence
  MISC_FEATURE (31)..(31): can be Aspartic Acid, Glutamic Acid, or Glycine
  MISC_FEATURE (33)..(33): can be Alanine or Valine
  MISC_FEATURE (35)..(35): can be Tyrosine or Histidine
  MISC_FEATURE (50)..(50): can be Valine or Leucine
  MISC_FEATURE (52)..(52): can be Arginine, Lysine, or Glutamine
  MISC_FEATURE (54)..(54): can be Tyrosine or Phenylalanine
  misc_feature (57)..(57): can be Aspartic Acid, Glutamic Acid, or Glycine
  MISC_FEATURE (58)..(58): can be Valine or Leucine
  MISC_FEATURE (59)..(59): can be Threonine or Serine
  MISC_FEATURE (65)..(65): can be Lysine, Arginine or Glutamine
  MISC_FEATURE (66)..(66): can be Aspartic Acid, Glutamic Acid, or Glycine
QVQLVQSGAEVKKPGASVKVSCKGSGYTFTXYXMXWVRQAPGQGLEWIGXIXTXSGXXXYNQKFXXRATMTVDKSISTAYMELSRLRSDDTAVYYCAKSGTVRGFAYWGQGTLVTVSS

SEQ ID NO: 204 - protein, 113 aa, Artificial Sequence
  Humanized VK A1 consensus seq
  MISC_FEATURE (29)..(29): can be Leucine or Valine
  MISC_FEATURE (30)..(30): can be Leucine, Isoleucine, Serine or Alanine
  MISC_FEATURE (31)..(31): can be Asparagine, Glutamine, Serine or Alanine
  MISC_FEATURE (32)..(32): can be Serine, Threonine, or Alanine
  MISC_FEATURE (34)..(34): can be Asparagine or Glutamine
  MISC_FEATURE (37)..(37): can be Asparagine or Glutamine
  MISC_FEATURE (40)..(40): can be Threonine, Serine or Alanine
  MISC_FEATURE (56)..(56): can be Tryptophan, Tyrosine, Phenylalanine, Glycine or Alanine
  MISC_FEATURE (61)..(61): can be Glutamic Acid or Alanine
  MISC_FEATURE (62)..(62): can be Serine, Threonine, or Alanine
  MISC_FEATURE (96)..(96): can be Asparagine or Glutamine
  MISC_FEATURE (99)..(99): can be Serine, Threonine, or Alanine
  MISC_FEATURE (100)..(100): can be Tyrosine, Phenylalanine, Leucine, or Alanine
DIVMTQSPPTLSLSPGERVTLSCKSSQSXXXXGXQKXYLXWYQQKPGQAPRLLIYXASTRXXGIPARFSGSGSGTDFTLTISSLQPEDFAVYHCQXDYXXPYTFGQGTKLEIK

SEQ ID NO: 205 - protein, 113 aa, Artificial Sequence
  Humanized VK A2 consensus seq
  MISC_FEATURE (33)..(33): can be Glycine or Serine
  MISC_FEATURE (40)..(40): can be Threonine or Serine
  MISC_FEATURE (97)..(97): can be Aspartic Acid or Glutamic Acid
  MISC_FEATURE (100)..(100): can be Tyrosine, Phenylalanine, or Serine
DIVMTQSPDSLAVSLGERATINCKSSQSLLNSXNQKNYLXWYQQKPGQPPKLLIYWASTRESGVPDRFSGSGSGTDFTLTISSLQAEDVAVYHCQNXYSXPYTFGQGTKLEIK

SEQ ID NO: 206 - protein, 118 aa, Artificial Sequence
  Humanized Version VH
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSS

SEQ ID NO: 207 - protein, 113 aa, Artificial Sequence
  Humanized Version VK A1
DIVMTQSPPTLSLSPGERVTLSCKSSQSLLNSGNQKNYLTWYQQKPGQAPRLLIYWASTRESGIPARFSGSGSGTDFTLTISSLQPEDFAVYHCQNDYSYPYTFGQGTKLEIK

SEQ ID NO: 208 - protein, 113 aa, Artificial Sequence
  Humanized Version VK A2
DIVMTQSPDSLAVSLGERATINCKSSQSLLNSGNQKNYLTWYQQKPGQPPKLLIYWASTRESGVPDRFSGSGSGTDFTLTISSLQAEDVAVYHCQNDYSYPYTFGQGTKLEIK

SEQ ID NO: 209 - DNA, 411 bp, Artificial Sequence
  Humanized Version VH A
atggattggacctggcggatcctgttcctggtggccgctgctacaggcgcccattctcaggtgcagctggtgcagtctggcgccgaagtgaagaaaccaggcgccagcgtgaaggtgtcctgcaagggcagcggctacacattcaccgactacgccatgtactgggtgcgacaggctcctggacagggcctggaatggatcggcgtgatcagaacctacagcggcgacgtgacctacaaccagaagttcaaggacagagccaccatgaccgtggacaagagcatcagcaccgcctacatggaactgagcagactgagaagcgacgacaccgccgtgtactactgcgccaagtctggcacagtgcggggcttcgcttactggggccagggcacactcgtgaccgtgtcgagc

SEQ ID NO: 210 - DNA, 399 bp, Artificial Sequence
  Humanized Version VK A1
atggaaacccctgcccagctgctgttcctgctgctgctgtggctgcctgacaccaccggcgacatcgtgatgacccagagccctcctaccctgagcctgagccctggcgagagagtgaccctgagctgcaagagcagccagagcctgctgaacagcggcaaccagaagaactacctgacctggtatcagcagaagcccggccaggcccccagactgctgatctactgggccagcacaagagagagcggcatccccgccagattcagcggatctggcagcggcaccgacttcaccctgaccatctctagcctgcagcccgaggacttcgccgtgtaccactgccagaacgactacagctacccctacaccttcggccagggcaccaagctggaaatcaag

SEQ ID NO: 211 - DNA, 399 bp, Artificial Sequence
  Humanized Version VK A2
atggtgctgcagacccaggtgttcatcagcctgctgctgtggatcagcggcgcctacggcgacatcgtgatgacccagagccctgacagcctggccgtgtctctgggcgagagagccaccatcaactgcaagagcagccagagcctgctgaacagcggcaaccagaagaactacctgacctggtatcagcagaagcccggccagccccccaagctgctgatctactgggccagcaccagagaaagcggcgtgcccgacagattcagcggcagcggctctggaaccgacttcaccctgaccatcagctccctgcaggccgaggatgtggccgtgtaccactgccagaacgactacagctacccctacaccttcggccagggcaccaagctggaaatcaag

SEQ ID NO: 212-214 - skipped (3 entries)

SEQ ID NO: 215 - protein, 118 aa, Artificial Sequence
  VH regions from germlined variants
QVQLVQSGTEVKKPGASVKVSCKGSGYTFTEYAMYWVRQAPGQGLEWIGVIRTYSGGVTYNQKFQGRATMTVDTSISTAYMELSRLRSDDTAVYYCAKSGTVRGFAYWGQGTLVTVSS

SEQ ID NO: 216 - protein, 118 aa, Artificial Sequence
  VH regions from germlined variants
QVQLVQSGAEVKKPGASVKVSCKASGYTFTEYAMYWVRQAPGQGMEWIGLIRTFSGEVSYNQKFQGRVTMTVDTSISTAYMELSRLRSDDTAVYYCAKSGTVRGLAYWGQGTLVTVSS

SEQ ID NO: 217 - protein, 118 aa, Artificial Sequence
  VH Antibody 2
QVQLVQSGAEVKKPGASVKVSCKASGYTFTEYAMHWVRQAPGQGMEWIGLIRTYSGGVSYNQKFRGRATMTVDKSISTAYMELSRLRSDDTAVYYCAKSGTVRGFAYWGQGTLVTVSS

SEQ ID NO: 218 - protein, 118 aa, Artificial Sequence
  VH Antibody 3
QVQLVQSGAEVKKPGASVKVSCKGSGYTFTGYVMHWVRQAPGQGMEWMGVIRTYSGEVSYNQKFQERVTMTVDKSISTAYMELSRLRSDDTAVYYCAKSGTVRGFAYWGQGTLVTVSS

SEQ ID NO: 219 - protein, 118 aa, Artificial Sequence
  VH Antibody 4
QVQLVQSGAEVKKPGASVKVSCKASGYTFTEYAMYWVRQAPGQSLEWMGLIRTFSGDVSYNQKFQDRVTMTVDKSISTAYMELSRLRSDDTAVYYCAKSGTVRGFAYWGQGTLVTVSS

SEQ ID NO: 220 - protein, 118 aa, Artificial Sequence
  VH Antibody 5
QVQLVQSGAEVKKPGASVKVSCKGSGYTFTEYAMHWVRQAPGQGLEWMGLIRTYSGGVTYNQKFRGRVTMTVDTSISTAYMELSRLRSDDTAVYYCAKSGTVRGFAYWGQGTLVTVSS

SEQ ID NO: 221 - protein, 118 aa, Artificial Sequence
  VH Antibody 6
QVQLVQSGAEVKKPGASVKVSCKGSGYTFTEYAMYWVRQAPGQGLEWMGLIRTFSGGVSYNQKFKGRATMTVDTSISTAYMELSRLRSDDTAVYYCAKSGTVRGFAYWGQGTLVTVSS

SEQ ID NO: 222 - protein, 118 aa, Artificial Sequence
  VH Antibody 7
QVQLVQSGAEVKKPGASVKVSCKASGYTFTGYAMHWVRQAPGQGMEWMGLIRTFSGGLSYNQKFRERVTMTVDTSISTAYMELSRLRSDDTAVYYCAKSGTVRGFAYWGQGTLVTVSS

SEQ ID NO: 223 - protein, 118 aa, Artificial Sequence
  VH Antibody 8
QVQLVQSGAEVKKPGASVKVSCKGSGYTFTGYVMYWVRQAPGQGLEWMGVIKTFSGGVSYNQKFQERVTMTVDKSISTAYMELSRLRSDDTAVYYCAKSGTVRGFAYWGQGTLVTVSS

SEQ ID NO: 224 - protein, 118 aa, Artificial Sequence
  VH Antibody 9
QVQLVQSGAEVKKPGASVKVSCKASGYTFTGYAMYWVRQAPGQGLEWMGLIRTYSGEVSYNQKFRGRATMTVDKSISTAYMELSRLRSDDTAVYYCAKSGTVRGFAYWGQGTLVTVSS

SEQ ID NO: 225 - protein, 118 aa, Artificial Sequence
  VH Antibody 10
QVQLVQSGAEVKKPGASVKVSCKASGYTFTEYAMYWVRQAPGQGLEWMGLIRTYSGGVSYNQKFRGRVTMTVDKSISTAYMELSRLRSDDTAVYYCAKSGTVRGFAYWGQGTLVTVSS

SEQ ID NO: 226 - protein, 118 aa, Artificial Sequence
  VH Antibody 11
QVQLVQSGAEVKKPGASVKVSCKGSGYTFTDYAMHWVRQAPGQGLEWMGLIRTYSGGVSYNQKFRGRVTMTVDTSISTAYMELSRLRSDDTAVYYCAKSGTVRGFAYWGQGTLVTVSS

SEQ ID NO: 227 - protein, 118 aa, Artificial Sequence
  VH Antibody 12
QVQLVQSGAEVKKPGASVKVSCKGSGYTFTGYAMYWVRQAPGQGLEWIGVIRTFSGEVSYNQKFKGRVTMTVDTSISTAYMELSRLRSDDTAVYYCAKSGTVRGFAYWGQGTLVTVSS

SEQ ID NO: 228 - protein, 118 aa, Artificial Sequence
  VH Antibody 13
QVQLVQSGAEVKKPGASVKVSCKASGYTFTGYAMYWVRQAPGQGLEWMGLIRTFSGDVTYNQKFRGRATMTVDKSISTAYMELSRLRSDDTAVYYCAKSGTVRGFAYWGQGTLVTVSS

SEQ ID NO: 229 - protein, 118 aa, Artificial Sequence
  VH Antibody 14
QVQLVQSGTEVKKPGASVKVSCKGSGYTFTGYVMHWVRQAPGQGLEWMGLIRTYSGDVSYNQKFRDRATMTVDTSISTAYMELSRLRSDDTAVYYCAKSGTVRGFAYWGQGTLVTVSS

SEQ ID NO: 230 - protein, 118 aa, Artificial Sequence
  VH Antibody 15
QVQLVQSGAEVKKPGASVKVSCKGSGYTFTDYAMYWVRQAPGQGLEWIGVIRTFSGDVSYNQKFRERATMTVDKSISTAYMELSRLRSDDTAVYYCAKSGTVRGFAYWGQGTLVTVSS

SEQ ID NO: 231 - protein, 118 aa, Artificial Sequence
  VH Antibody 16
QVQLVQSGTEVKKPGASVKVSCKASGYTFTGYAMYWVRQAPGQGLEWIGLIRTFSGGVTYNQKFRERVTMTVDKSISTAYMELSRLRSDDTAVYYCAKSGTVRGFAYWGQGTLVTVSS

SEQ ID NO: 232 - protein, 118 aa, Artificial Sequence
  VH Antibody 17
QVQLVQSGAEVKKPGASVKVSCKASGYTFTEYAMYWVRQAPGQGLEWMGVIQTFSGGVTYNQKFRGRATMTVDKSISTAYMELSRLRSDDTAVYYCAKSGTVRGFAYWGQGTLVTVSS

SEQ ID NO: 233 - protein, 118 aa, Artificial Sequence
  VH Antibody 18
QVQLVQSGTEVKKPGASVKVSCKASGYTFTGYAMYWVRQAPGQGMEWIGLIRTFSGEVTYNQKFRGRVTMTVDTSISTAYMELSRLRSDDTAVYYCAKSGTVRGFAYWGQGTLVTVSS

SEQ ID NO: 234 - protein, 118 aa, Artificial Sequence
  VH Antibody 19
QVQLVQSGAEVKKPGASVKVSCKGSGYTFTGYAMYWVRQAPGQGLEWMGLIRTYSGGLSYNQKFQDRATMTVDTSISTAYMELSRLRSDDTAVYYCAKSGTVRGFAYWGQGTLVTVSS

SEQ ID NO: 235 - protein, 118 aa, Artificial Sequence
  VH
QVQLVQSGAEVKKPGASVKVSCKGSGYTFTEYAMYWVRQAPGQGMEWIGVIRTFSGGLTYNQKFKGRVTMTVDKSISTAYMELSRLRSDDTAVYYCAKSGTVRGFAYWGQGTLVTVSS

SEQ ID NO: 236 - protein, 118 aa, Artificial Sequence
  VH Antibody 20
QVQLVQSGTEVKKPGASVKVSCKASGYTFTDYAMYWVRQAPGQGLEWIGVIRTFSGDLSYNQKFRGRVTMTVDTSISTAYMELSRLRSDDTAVYYCAKSGTVRGFAYWGQGTLVTVSS

SEQ ID NO: 237 - protein, 118 aa, Artificial Sequence
  VH Antibody 21
QVQLVQSGTEVKKPGASVKVSCKGSGYTFTGYVMHWVRQAPGQGMEWIGVIRTFSGDVSYNQKFRERVTMTVDTSISTAYMELSRLRSDDTAVYYCAKSGTVRGFAYWGQGTLVTVSS

SEQ ID NO: 238 - protein, 118 aa, Artificial Sequence
  VH Antibody 22
QVQLVQSGAEVKKPGASVKVSCKASGYTFTGYAMYWVRQAPGQGMEWIGVIRTFSGDVTYNQKFRGRATMTVDTSISTAYMELSRLRSDDTAVYYCAKSGTVRGFAYWGQGTLVTVSS

SEQ ID NO: 239 - protein, 118 aa, Artificial Sequence
  VH Antibody 23
QVQLVQSGTEVKKPGASVKVSCKGSGYTFTGYAMYWVRQAPGQGMEWIGLIRTFSGDVTYNQKFRGRATMTVDKSISTAYMELSRLRSDDTAVYYCAKSGTVRGFAYWGQGTLVTVSS

SEQ ID NO: 240 - protein, 118 aa, Artificial Sequence
  VH Antibody 24
QVQLVQSGAEVKKPGASVKASCKGSGYTFTDYAMHWVRQAPGQGMEWIGLIRTYSGGVTYNQKFRGRVTMTVDKSISTAYMELSRLRSDDTAVYYCAKSGTVRGFAYWGQGTLVTVSS

SEQ ID NO: 241 - protein, 118 aa, Artificial Sequence
  VH Antibody 25
QVQLVQSGAEVKKPGASVKVSCKASGYTFTEYAMYWVRQAPGQGLEWMGLIRTFSGGVSYNQKFRGRATMTVDTSISTAYMELSRLRSDDTAVYYCAKSGTVRGFAYWGQGTLVTVSS

SEQ ID NO: 242 - protein, 118 aa, Artificial Sequence
  VH Antibody 26
QVQLVQSGTEVKKPGASVKVSCKGSGYTFTEYAMHWVRQAPGQGMEWMGLIRTFSGDVSYNQKFKGRVTMTVDKSISTAYMELSRLRSDDTAVYYCAKSGTVRGFAYWGQGTLVTVSS

SEQ ID NO: 243 - protein, 118 aa, Artificial Sequence
  VH Antibody 27
QVQLVQSGTEVKKPGASVKVSCKGSGYTFTDYAMYWVRQAPGQGMEWMGLIRTYSGGVSYNQKFRGRVTMTVDTSISTAYMELSRLRSDDTAVYYCAKSGTVRGFAYWGQGTLVTVSS

SEQ ID NO: 244 - protein, 118 aa, Artificial Sequence
  VH Antibody 28
QVQLVQSGTEVKKPGASVKVSCKGSGYTFTDYAMYWVRQAPGQGLEWIGVIRTFSGGVTYNQKFRGRATMTVDKSISTAYMELSRLRSDDTAVYYCAKSGTVRGFAYWGQGTLVTVSS

SEQ ID NO: 245 - protein, 118 aa, Artificial Sequence
  VH Antibody 29
QVQLVQSGAEVKKPGASVKVSCKGSGYTFTDYAMYWVRQAPGQGLEWIGVIRTFSGGVTYNQKFKGRATMTVDTSISTAYMELSRLRSDDTAVYYCAKSGTVRGFAYWGQGTLVTVSS

SEQ ID NO: 246 - protein, 118 aa, Artificial Sequence
  VH Antibody 30
QVQLVQSGAEVKKPGASVKVSCKGSGYTFTDYVMYWVRQAPGQGLEWMGVIRTFSGGLSYNQKFRGRVTMTVDTSISTAYMELSRLRSDDTAVYYCAKSGTVRGFAYWGQGTLVTVSS

SEQ ID NO: 247 - protein, 118 aa, Artificial Sequence
  VH Antibody 31
QVQLVQSGTEVKKPGASVKVSCKGSGYTFTEYAMYWVRQAPGQGLEWMGLIRTFSGGLTYNQKFKDRVTMTVDKSISTAYMELSRLRSDDTAVYYCAKSGTVRGFAYWGQGIPVTVSS

SEQ ID NO: 248 - protein, 118 aa, Artificial Sequence
  VH Antibody 32
QVQLVQSGAEVKKPGASVKVSCKASGYTFTDYAMYWVRQAPGQGMEWMGVIRTFSGGVTYNQKFKDRATMTVDKSISTAYMELSRLRSDDTAVYYCAKSGTVRGFAYWGQGTLVTVSS

SEQ ID NO: 249 - protein, 118 aa, Artificial Sequence
  VH Antibody 33
QVQLVQSGAEVKKPGASVKVSCKASGYTFTGYAMYWVRQAPGQGMEWIGLIRTYSGGVTYNQKFQGRVTMTVDTSISTAYMELSRLRSDDTAVYYCAKSGTVRGFAYWGQGTLVTVSS

SEQ ID NO: 250 - protein, 118 aa, Artificial Sequence
  VH Antibody 34
QVQLVQSGAEVKKPGASVKVSCKASGYTFTDYAMYWVRQAPGQGMEWIGVIRTFSGGVTYNQKFRGRVTMTVDTSISTAYMELSRLRSDDTAVYYCAKSGTVRGFAYWGQGTLVTVSS

SEQ ID NO: 251 - protein, 118 aa, Artificial Sequence
  VH Antibody 35
QVQLVQSGAEAKKPGASVKVSCKGSGYTFTGYAMYWVRQAPGQGMEWIGVIRTFSGDVTYNQKFRGRVTMTVDTSISTAYMELSRLRSDDTAVYYCAKSGTVRGFAYWGQGTLVTVSS

SEQ ID NO: 252 - protein, 118 aa, Artificial Sequence
  VH Antibody 36
QVQLVQSGAEVKKPGASVKVSCKGSGYTFTDYAMYWVRQAPGQGMEWIGVIRTFSGGVSYNQKFRDRVTMTVDKSISTAYMELSRLRSDDTAVYYCAKSGTVRGFAYWGQGTLVTVSS

SEQ ID NO: 253 - protein, 118 aa, Artificial Sequence
  VH Antibody 37
QVQLVQSGTEVKKPGASVKVSCKGSGYTFTEYAMYWVRQAPGQGMEWIGLIRTFSGEVTYNQKFKDRVTMTVDTSISTAYMELSRLRSDDTAVYYCAKSGTVRGFAYWGQGTLVTVSS

SEQ ID NO: 254 - protein, 118 aa, Artificial Sequence
  VH Antibody 38
QVQLVQSGTEVKKPGASVKVSCKGSGYTFTGYAMYWVRQAPGQGLEWIGVIKTYSGGVTYNQKFRGRVTMTVDKSISTAYMELSRLRSDDTAVYYCAKSGTVRGFAYWGQGTLVTVSS

SEQ ID NO: 255 - protein, 118 aa, Artificial Sequence
  VH Antibody 39
QVQLVQSGAEVKKPGASVKVSCKGSGYTFTGYAMHWVRQAPGQGLEWMGLIRTYSGGVSYNQKFRERATMTVDTSISTAYMELSRLRSDDTAVYYCAKSGTVRGFAYWGQGTLITVSS

SEQ ID NO: 256 - protein, 118 aa, Artificial Sequence
  VH Antibody 40
QVQLVQSGAEVKKPGASVKVSCKASGYTFTEYAMYWVRQAPGQGLEWIGVIRTYSGDLSYNQKFRGRVTMTVDKSISTAYMELSRLRSDDTAVYYCAKSGTVRGFAYWGQGTLVTVSS

SEQ ID NO: 257 - protein, 118 aa, Artificial Sequence
  VH
QVQLVQSGTEVKKPGASVKVSCKASGYTFTEYAMYWVRQAPGQGMEWIGVIRTFSGGVTYNQKFQERVTMTVDKSISTAYMELSRLRSDDTAVYYCAKSGTVRGFAYWGQGTLVTVSS

SEQ ID NO: 258 - protein, 118 aa, Artificial Sequence
  VH Antibody 41
QVQLVQSGAEVKKPGASVKVSCKGSGYTFTDYVMYWVRQAPGQGLEWMGVIRTFSGGVSYNQKFRGRATMTVDKSISTAYMELSRLRSDDTAVYYCAKSGTVRGFAYWGQGTLVTVSS

SEQ ID NO: 259 - protein, 118 aa, Artificial Sequence
  VH Antibody 42
QVQLVQSGTEVKKPGASVKVSCKASGYTFTDYAMYWVRQAPGQGLEWIGVIRTFSGDLTYNQKFQDRVTMTVDTSISTAYMELSRLRSDDTAVYYCAKSGTVRGFAYWGQGTLVTVSS

SEQ ID NO: 260 - protein, 118 aa, Artificial Sequence
  VH
QVQLVQSGAEVKKPGASVKVSCKASGYTFTDYAMYWVRQAPGQGMEWMGLIRTYSGEVSYNQKFRERATMTVDTSISTAYMELSRLRSDDTAVYYCAKSGTVRGFAYWGQGTLVTVSS

SEQ ID NO: 261 - protein, 118 aa, Artificial Sequence
  VH Antibody 43
QVQLVQSGAEVKKPGASVKVSCKGSGYTFTEYAMYWVRQAPGQGMEWIGLIRTFSGDVSYNQKFKGRATMTVDKSISTAYMELSRLRSDDTAVYYCAKSGTVRGFAYWGQGTLVTVSS

SEQ ID NO: 262 - protein, 118 aa, Artificial Sequence
  VH Antibody 44
QVQLVQSGTEVKKPGASVKVSCKGSGYTFTEYAMHWVRQAPGQGLEWMGLIRTYSGDVSYNQKFQGRATMTVDTSISTAYMELSRLRSDDTAVYYCAKSGTVRGFAYWGQGTLVTVSS

SEQ ID NO: 263 - protein, 118 aa, Artificial Sequence
  VH Antibody 45
QVQLVQSGAEVKKPGASVKVSCKGSGYTFTEYAMYWVRQAPGQGLEWIGLIRTYSGGVSYNQKFQGRVTMTVDTSISTAYMELSRLRSDDTAVYYCAKSGTVRGFAYWGQGTFVTVSS

SEQ ID NO: 264 - protein, 118 aa, Artificial Sequence
  VH Antibody 46
QVQLVQSGAEVKKPGASVKVSCKASGYTFTEYAMYWVRQAPGQGLEWMGLIRTFSGDLSYNQKFRGRVTMTVDTSISTAYMELSRLRSDDTAVYYCAKSGTVRGFAYWGQGTLVTVSS

SEQ ID NO: 265 - protein, 118 aa, Artificial Sequence
  VH Antibody 47
QVQLVQSGAEVKKPGASVKVSCKASGYTFTDYAMYWVRQAPGQGMEWMGVIRTYSGGVTYNQKFRDRVTMTVDKSISTAYMELSRLRSDDTAVYYCAKSGTVRGFADWGQGTLVTVSS

SEQ ID NO: 266 - protein, 118 aa, Artificial Sequence
  VH
QVQLVQSGTEVKKPGASVKVSCKGSGYTFTGYAMYWVRQAPGQGMEWIGLIRTYSGGVTYNQKFRGRATMTVDKSISTAYMELSRLRSDDTAVYYCAKSGTVRGFAYWGQGTLVTVSS

SEQ ID NO: 267 - protein, 118 aa, Artificial Sequence
  VH Antibody 48
QVQLVQSGAEVKKPGASVKVSCKASGYTFTDYAMYWVRQAPGQGLEWMGLIRTYSGGVTYNQKFKERATMTVDKSISTAYMELSRLRSDDTAVYYCAKSGTVRGFAYWGQGTLVTVSS

SEQ ID NO: 268 - protein, 118 aa, Artificial Sequence
  VH Antibody 49
QVQLVQSGTEVKKPGASVKVSCKGSGYTFTGYAMYWVRQAPGQGLEWMGVIRTYSGDVTYNQKFRERATMTVDTSISTAYMELSRLRSDDTAVYYCAKSGTVRGFAYWGQGTLVTVSS

SEQ ID NO: 269 - protein, 118 aa, Artificial Sequence
  VH
QVQLVQSGAEVKKPGASVKVSCKGSGYTFTGYAMYWVRQAPGQGMEWMGLIRTYSGEVSYNQKFQGRVTMTVDKSISTAYMELSRLRSDDTAVYYCAKSGTVRGFAYWGQGTLVTVSS

SEQ ID NO: 270 - protein, 118 aa, Artificial Sequence
  VH Antibody 50
QVQLVQSGTEVKKPGASVKVSCKASGYTFTDYAMYWVRQAPGQGLEWIGLIRTFSGGVSYNQKFKERVTMTVDKSISTAYMELSRLRSDDTAVYYCAKSGTVRGFAYWGQGTLVTVSS

SEQ ID NO: 271 - protein, 118 aa, Artificial Sequence
  VH Antibody 51
QVQLVQSGTEVKKPGASVKVSCKASGYTFTEYAMYWVRQAPGQGLEWMGVIRTFSGGVTYNQKFKGRATMTVDTSISTAYMELSRLRSDDTAVYYCAKSGTVRGFAYWGQGTLVTVSS

SEQ ID NO: 272 - protein, 118 aa, Artificial Sequence
  VH Antibody 52
QVQLVQSGTEVKKPGASVKVSCKGSGYTFTDYAMYWVRQAPGQGLEWMGLIRTYSGGVSYNQKFRERVTMTVDKSISTAYMELSRLRSDDTAVYYCAKSGTVRGFAYWGQGTLVTVSS

SEQ ID NO: 273 - protein, 118 aa, Artificial Sequence
  VH Antibody 53
QVQLVQSGTEVKKPGASVKVSCKASGYTFTEYAMHWVRQAPGQGMEWMGVIRTYSGGLSYNQKFRGRATMTVDKSISTAYMELSRLRSDDTAVYYCAKSGTVRGFAYWGQGTLVTVSS

SEQ ID NO: 274 - protein, 118 aa, Artificial Sequence
  VH
QVQLVQSGTEVKKPGASVKVSCKGSGYTFTDYAMYWVRQAPGQGLEWIGVIRTFSGEVTYNQKFQERVTMTVDASISTAYMELSRLRSDDTAVYYCAKSGTVRGFAYWGQGTLVTVSS

SEQ ID NO: 275 - protein, 118 aa, Artificial Sequence
  VH
QVQLVQSGAEVKKPGASVKVSCKGSGYTFTEYAMYWVRQAPGQGMEWMGLIRTFSGDVSYNQKFRGRVTMTVDTSISTAYMELSRLRSDDTAVYYCAKSGTVRGFAYWGQGTLVTVSS

SEQ ID NO: 276 - protein, 118 aa, Artificial Sequence
  VH Antibody 54
QVQLVQSGAEVKKPGASVKVSCKASGYTFTEYAMHWVRQAPGQGLEWMGLIRTYSGGVSYNQKFQGRATMTVDTSISTAYMELSRLRSDDTAVYYCAKSGTVRGFAYWGQGTLVTVSS

SEQ ID NO: 277 - protein, 118 aa, Artificial Sequence
  VH Antibody 55
QVQLVQSGTEVKKPGASVKVSCKASGYTFTDYAMYWVRQAPGQGLEWIGLIRTYSGGVTYNQKFQGRVTMTVDTSISTAYMELSRLRSDDTAVYYCAKSGTVRGFAYWGQGTLVTVSS

SEQ ID NO: 278 - protein, 118 aa, Artificial Sequence
  VH
QVQLVQSGAEVKKPGASVKVSCKASGYTFTDYAMYWVRQAPGQGLEWMGVIRTYSGDVTYNQKFRERATMTVDTSISTAYMELSRLRSDDTAVYYCAKSGTVRGFAYWGQGTLVTVSS

SEQ ID NO: 279 - protein, 118 aa, Artificial Sequence
  VH
QVQLVQSGTEVKKPGASVKVSCKGSGYTFTDYAMYWVRQAPGQGMEWMGVIKTYSGGVTYNQKFKGRATMTVDKSISTAYMELSRLRSDDTAVYYCAKSGTVRGFAYWGQGTLVTVSS

SEQ ID NO: 280 - protein, 118 aa, Artificial Sequence
  VH Antibody 56
QVQLVQSGTEVKKPGASVKVSCKGSGYTFTDYAMYWVRQAPGQGMEWMGVIRTYSGDVSYNQKFRGRVTMTVDTSISTAYMELSRLRSDDTAVYYCAKSGTVRGFAYWGQGTLVTVSS

SEQ ID NO: 281 - protein, 118 aa, Artificial Sequence
  VH Antibody 57
QVQLVQSGTEVKKPGASVKVSCKGSGYTFTGYAMYWVRQAPGQGMEWIGLIRTYSGDVTYNQKFKDRVTMTVDTSISTAYMELSRLRSDDTAVYYCAKSGTVRGFAYWGQGTLVTVSS

SEQ ID NO: 282 - protein, 118 aa, Artificial Sequence
  VH
QVQLVQSGAEVKKPGASVKVSCKGSGYTFTDYAMHWVRQAPGQGLEWIGLIRTYSGGVSYNQKFRERVTMTVDTSISTAYMELSRLRSDDTAVYYCAKSGTVRGFAYWGQGTLVTVSS

SEQ ID NO: 283 - protein, 118 aa, Artificial Sequence
  VH Antibody 58
QVQLVQSGAEVKKPGASVKVSCKGSGYTFTDYAMYWVRQAPGQGLEWMGVIRTYSGGVTYNQKFKGRATMTVDKSISTAYMELSRLRSDDTAVYYCAKSGTVRGFAYWGQGTLVTVSS

SEQ ID NO: 284 - protein, 118 aa, Artificial Sequence
  VH Antibody 59
QVQLVQSGAEVKKPGASVKVSCKASGYTFTEYAMYWVRQAPGQGLEWMGLIRTYSGGVSYNQKFRDRVTMTVDKSISTAYMELSRLRSDDTAVYYCAKSGTVRGFAYWGQGTLVTVSS

SEQ ID NO: 285 - protein, 118 aa, Artificial Sequence
  VH Antibody 60
QVQLVQSGAEVKKPGASVKVSCKGSGYTFTDYAMYWVRQAPGQGLEWMGVIKTYSGGVSYNQKFRGRATMTVDKSISTAYMELSRLRSDDTAVYYCAKSGTVRGFAYWGQGTLVTVSS

SEQ ID NO: 286 - protein, 118 aa, Artificial Sequence
  VH
QVQLVQSGGEVKKPGASVKVSCKGSGYTFTGYAMHWVRQAPGQGLEWIGVIRTFSGGVTYNQKFPGRGSMTVDKSISTAYMELSRLRSDDTAVYYCAKSGTVRGFAYWGQGTLVTVSS

SEQ ID NO: 287 - protein, 118 aa, Artificial Sequence
  VH Antibody 61
QVQLVQSGTEVKKPGASVKVSCKASGYTFTEYAMHWVRQAPGQGLEWMGLIRTYSGGVSYNQKFQERVTMTVDKSISTAYMELSRLRSDDTAVYYCAKSGTVRGFAYWGQGTLVTVSS

SEQ ID NO: 288 - protein, 118 aa, Artificial Sequence
  VH Antibody 62
QVQLVQSGAEVKKPGASVKVSCKGSGYTFTGYVMYWVRQAPGQGMEWMGVIRTFSGGVSYNQKFQGRATMTVDKSISTAYMELSRLRSDDTAVYYCAKSGTVRGFAYWGQGTLVTVSS

SEQ ID NO: 289 - protein, 118 aa, Artificial Sequence
  VH
QVQLVQSGTEVKKPGASVKVSCKGSGYTFTDYAMYWVRQAPGQGLEWIGVIRTFSGGVTYNQKFRGRVTMTVDTSISTAYMELSRLRSDDTAVYYCAKSGTVRGFAYWGQGTLVTVSS

SEQ ID NO: 290 - protein, 118 aa, Artificial Sequence
  VH Antibody 63
QVQLVQSGAEVKKPGASVKVSCKASGYTFTEYAMYWVRQAPGQGLEWIGVIRTFSGDVTYNQKFKGRVTMTVDKSISTAYMELSRLRSDDTAVYYCAKSGTVRGFAYWGQGTLVTVSS

SEQ ID NO: 291 - protein, 118 aa, Artificial Sequence
  VH Antibody 64
QVQLVQSGAEVKKPGASVKVSCKASGYTFTDYAMYWVRQAPGQGLEWMGVIRTYSGDVTYNQKFRGRATMTVDTSISTAYMELSRLRSDDTAVYYCAKSGTVRGFAYWGQGTLVTVSS

SEQ ID NO: 292 - protein, 118 aa, Artificial Sequence
  VH
QVQLVQSGTEVKKPGASVKVSCKGSGYTFTGYAMYWVRQAPGQGMEWIGVIRTYSGGVTYNQKFRGRVTMTVDTSISTAYMELSRLRSDDTAVYYCAKSGTVRGFAYWGQGTLVTVSS

SEQ ID NO: 293 - protein, 118 aa, Artificial Sequence
  VH
QVQLVQSGAEVKKPGASVKVSCKGSGYTFTDYAMYWVRQAPGQGLEWIGVIRTFSGGLSYNQKFRDRVTMTVDTSISTAYMELSRLRSDDTAVYYCAKSGTVRGFAYWGQGTLVTVSS

SEQ ID NO: 294 - protein, 118 aa, Artificial Sequence
  VH
QVQLVQSGAEVKKPGASVKVSCKGSGYTFTEYAMYWVRQAPGQGLEWMGVIKTYSGGVTYNQKFRGRVTMTVDKSISTAYMELSRLRSDDTAVYYCAKSGTVRGFAYWGQGTLVTVSS

SEQ ID NO: 295 - protein, 118 aa, Artificial Sequence
  VH
QVQLVQSGTEVKKPGASVKVSCKGSGYTFTGYAMYWVRQAPGQGMEWMGLIRTFSGDVSYNQKFRDRVTMTVDTSISTAYMELSRLRSDDTAVYYCAKSGTVRGFAYWGQGTLVTVSS

SEQ ID NO: 296 - protein, 118 aa, Artificial Sequence
  VH Antibody 66
QVQLVQSGTEVKKPGASVKVSCKGSGYTFTDYVMYWVRQAPGQGLEWMGVIRTYSGEVSYNQKFRGRVTMTVDTSISTAYMELSRLRSDDTAVYYCAKSGTVRGFAYWGQGTLVTVSS

SEQ ID NO: 297 - protein, 118 aa, Artificial Sequence
  VH Antibody 67
QVQLVQSGAEVKKPGASVKVSCKGSGYTFTEYAMYWVRQAPGQGLEWMGVIQTFSGDVSYNQKFKGRVTMTVDKSISTAYMELSRLRSDDTAVYYCAKSGTVRGFAYWGQGTLVTVSS

SEQ ID NO: 298 - protein, 118 aa, Artificial Sequence
  VH Antibody 68
QVQLVQSGTEVKKPGASVKVSCKGSGYTFTGYAMYWVRQAPGQGLEWIGLIRTYSGGVTYNQKFRGRVTMTVDTSISTAYMELSRLRSDDTAVYYCAKSGTVRGFAYWGQGTLVTVSS

SEQ ID NO: 299 - protein, 118 aa, Artificial Sequence
  VH Antibody 69
QVQLVQSGTEVKKPGASVKVSCKGSGYTFTEYVMHWVRQAPGQGMEWMGVIRTFSGGVSYNQKFRERATMTVDTSISTAYMELSRLRSDDTAVYYCAKSGTVRGFAYWGQGTLVTVSS

SEQ ID NO: 300 - protein, 118 aa, Artificial Sequence
  VH
QVQLVQSGAEVKKPGASVKVSCKASGYTFTGYAMYWVRQAPGQGLEWMGLIRTYSGDVTYNQKFRGRVTMTVDTSISTAYMELSRLRSDDTAVYYCAKSGTVRGFAYWGQGTLVTVSS

SEQ ID NO: 301 - protein, 118 aa, Artificial Sequence
  VH Antibody 70
QVQLVQSGTEVKKPGASVKVSCKASGYTFTGYAMYWVRQAPGQGMEWIGVIRTYSGDVTYNQKFKDRATMTVDTSISTAYMELSRLRSDDTAVYYCAKSGTVRGFAYWGQGTLVTVSS

SEQ ID NO: 302 - protein, 118 aa, Artificial Sequence
  VH
QVQLVQSGAEVKKPGASVKVSCKASGYTFTDYAMYWVRQAPGQGMEWIGLIQTYSGGLSYNQKFRERVTMTVDTSISTAYMELSRLRSDDTAVYYCAKSGTVRGFAYWGQGTLVTVSS

SEQ ID NO: 303 - protein, 118 aa, Artificial Sequence
  VH
QVQLVQSGAEVKKPGASVKVSCKASGYTFTEYVMYWVRQAPGQGMEWMGVIRTFSGDVSYNQKFRDRATMTVDKSISTAYMELSRLRSDDTAVYYCAKSGTVRGFAYWGQGTLVTVSS

SEQ ID NO: 304 - protein, 118 aa, Artificial Sequence
  VH Antibody 71
QVQLVQSGAEVKKPGASVKVSCKASGYTFTGYAMYWVRQAPGQGMEWMGVIRTFSGGVTYNQKFRGRATMTVDTSISTAYMELSRLRSDDTAVYYCAKSGTVRGFAYWGQGTLVTVSS

SEQ ID NO: 305 - protein, 118 aa, Artificial Sequence
  Antibody 72
QVQLVQSGAEVKKPGASVKVSCKGSGYTFTGYAMYWVRQAPGQGLEWMGVIRTYSGDVSYNQKFQERATMTVDTSISTAYMELSRLRSDDTAVYYCAKSGTVRGFAYWGQGTLVTVSS

SEQ ID NO: 306 - protein, 118 aa, Artificial Sequence
  VH Antibody 73
QVQLVQSGAEVKKPGASVKVSCKGSGYTFTGYVMHWVRQAPGQGMEWIGIIKTYSGGVSYNQKFQGRVTMTVDKSISTAYMELSRLRSDDTAVYYCAKSGTVRGFAYWGQGTLVTVSS

SEQ ID NO: 307 - protein, 118 aa, Artificial Sequence
  VH
QVQLVQSGAEVKKPGASVKVSCKGSGYTFTEYAMHWVRQAPGQGMEWIGLIRTFSGDLSYNQKFRGRATMTVDKSISTAYMELSRLRSDDTAVYYCAKSGTVRGFAYWGQGTLVTVSS

SEQ ID NO: 308 - protein, 118 aa, Artificial Sequence
  VH Antibody 74
QVQLVQSGTEVKKPGASVKVSCKGSGYTFTDYAMYWVRQAPGQGMEWIGVIKTYSGGVTYNQKFKDRATMTVDTSISTAYMELSRLRSDDTAVYYCAKSGTVRGFAYWGQGTLVTVSS

SEQ ID NO: 309 - protein, 118 aa, Artificial Sequence
  VH
QVQLVQSGTEVKKPGASVKVSCKASGYTFTDYVMHWVRQAPGQGMEWMGLIRTYSGGVTYNQKFQGRATMTVDKSISTAYMELSRLRSDDTAVYYCAKSGTVRGFAYWGQGTLVTVSS

SEQ ID NO: 310 - protein, 118 aa, Artificial Sequence
  VH
QVQLVQSGTEVKKPGASVKVSCKGSGYTFTDYAMYWVRQAPGQGMEWIGVIRTFSGGVTYNQKFKGRVTMTVDTSISTAYMELSRLRSDDTAVYYCAKSGTVRGFAYWGQGTLVTVSS

SEQ ID NO: 311 - protein, 118 aa, Artificial Sequence
  VH
QVQLVQSGAEVKKPGASVKVSCKASGYTFTGYAMYWVRQAPGQGMEWIGVIRTFSGDVSYNQKFRERVTMTVDKSISTAYMELSRLRSDDTAVYYCAKSGTVRGFAYWGQGTLVTVSS

SEQ ID NO: 312 - protein, 118 aa, Artificial Sequence
  VH
QVQLVQSGAEVKKPGASVKVSCKASGYTFTEYVMYWVRQAPGQGMEWIGVIQTYSGGLSYNQKFRGRVTMTVDKSISTAYMELSRLRSDDTAVYYCAKSGTVRGFAYWGQGTLVTVSS

SEQ ID NO: 313 - protein, 118 aa, Artificial Sequence
  VH Antibody 75
QVQLVQSGTEVKKPGASVKVSCKGSGYTFTGYAMYWVRQAPGQGLEWIGVIRTYSGGVTYNQKFQGRVTMTVDKSISTAYMELSRLRSDDTAVYYCAKSGTVRGFAYWGQGTLVTVSS

SEQ ID NO: 314 - protein, 118 aa, Artificial Sequence
  VH Antibody 76
QVQLVQSGAGVKKPGASVKVSCKGSGYTFTDYAMHWVRQAPGQGLEWMGLIRTFSGDVSYNQKFRERATMTVDKSISTAYMELSRLRSDDTAVYYCAKSGTVRGFAYWGQGTLVTVSS

SEQ ID NO: 315 - protein, 118 aa, Artificial Sequence
  VH Antibody 77
QVQLVQSGAEVKKPGASVKVSCKGSGYTFTEYAMHWVRQAPGQGLEWIGLIQTYSGDVSYNQKFRGRATMTVDTSISTAYMELSRLRSDDTAVYYCAKSGTVRGFAYWGQGTLVTVSS

SEQ ID NO: 316 - protein, 118 aa, Artificial Sequence
  VH Antibody 78
QVQLVQSGAEVKKPGASVKVSCKGSGYTFTDYAMYWVRQAPGQGLEWIGVIKTYSGGVTYNQKFRDRATMTVDTSISTAYMELSRLRGDDTAVYYCAKSGTVRGFAYWGRGTLVTVSS

SEQ ID NO: 317 - protein, 118 aa, Artificial Sequence
  VH
QVQLVQSGTEVKKPGASVKVSCKGSGYTFTGYAMHWVRQAPGQGMEWMGLIRTYSGGVSYNQKFRDRVTMTVDKSISTAYMELSRLRSDDTAVYYCAKSGTVRGFAYWGQGTLVTVSS

SEQ ID NO: 318 - protein, 118 aa, Artificial Sequence
  VH
QVQLVQSGTEVKKPGASVKVSCKGSGYTFTEYAMHWVRQAPGQGMEWIGLIRTYSGGVSYNQKFKGRVTMTVDKSISTAYMELSRLRSDDTAVYYCAKSGTVRGFAYWGQGTLVTVSS

SEQ ID NO: 319 - protein, 118 aa, Artificial Sequence
  VH Antibody 79
QVQLVQSGTEVKKPGASVKVSCKGSGYTFTEYAMHWVRQAPGQGMEWMGLIRTYSGGVTYNQKFRERVTMTVDKSISTAYMELSRLRSDDTAVYYCAKSGTVRGFAYWGQGTLVTVSS

SEQ ID NO: 320 - protein, 118 aa, Artificial Sequence
  VH Antibody 80
QVQLVQSGTEVKKPGASVKVSCKASGYTFTEYAMHWVRQAPGQGMEWMGLIRTFSGDVSYNQKFRGRVTMTVDTSISTAYMELSRLRSDDTAVYYCAKSGTVRGFAYWGQGTLVTVSS

SEQ ID NO: 321 - protein, 118 aa, Artificial Sequence
  VH
QVQLVQSGAEVKKPGASVKVSCKGSGYTFTDYAMYWVRQAPGQGMEWMGVIRTFSGGVSYNQKFRDRVTMTVDTSISTAYMELSRLRSDDTAVYYCAKSGTVRGFAYWGQGTLVTVSS

SEQ ID NO: 322 - protein, 118 aa, Artificial Sequence
  VH Antibody 81
QVQLVQSGTEVKKPGASVKVSCKASGYTFTDYAMYWVRQAPGQGLEWMGLIRTFSGEVSYNQKFQDRATMTVDTSISTAYMELSRLRSDDTAVYYCAKSGTVRGFAYWGQGTLVTVSS

SEQ ID NO: 323 - protein, 118 aa, Artificial Sequence
  VH Antibody 82
QVQLVQSGAEVKKPGASVKVSCKGSGYTFTGYVMHWVRQAPGQGMEWMGVIRTFSGGVSYNQKFRGRVTMTVDKSISTAYMELSRLRSDDTAVYYCAKSGTVRGFAYWGQGTLVTVSS

SEQ ID NO: 324 - protein, 118 aa, Artificial Sequence
  Antibody 83
QVQLVQSGAEVKKPGASVKVSCKGSGYTFTGYAMYWVRQAPGQGMEWMGVIRTFSGDVSYNQKFRDRVTMTVDTSISTAYMELSRLRSDDTAVYYCAKSGTVRGFAYWGQGTLVTVSS

SEQ ID NO: 325 - protein, 118 aa, Artificial Sequence
  VH Antibody 84
QVQLVQSGTEVKKPGASVKVSCKGSGYTFTGYAMYWVRQAPGQGMEWMGLIRTFSGDVTYNQKFRGRATMTVDTSISTAYMELSRLRSDDTAVYYCAKSGTVRGFAYWGQGTLVTVSS

SEQ ID NO: 326 - protein, 118 aa, Artificial Sequence
  VH
QVQLVQSGTEVKKPGASVKVSCKGSGYTFTEYAMHWVRQAPGQGMEWIGLIRTYSGDVSYNQKFRGRVTMTVDTSISTAYMELSRLRSDDTAVYYCAKSGTVRGFAYWGQGTLVTVSS

SEQ ID NO: 327 - protein, 118 aa, Artificial Sequence
  VH Antibody 85
QVQLVQSGAEVKKPGASVKVSCKASGYTFTEYAMYWVRQAPGQGLEWMGVIRTYSGGVTYNQKFKDRATMTVDTSISTAYMELSRLRSDDTAVYYCAKSGTVRGFAYWGQGTLVTVSS

SEQ ID NO: 328 - protein, 118 aa, Artificial Sequence
  Vh Antibody 86
QVQLVQSGAEVKKPGASVKVSCKGSGYTFTEYAMYWVRQAPGQGMEWMGVIRTYSGGVTYNQKFRDRATMTVDTSISTAYMELSRLRSDDTAVYYCAKSGTVRGFAYWGQGTLVTVSS

SEQ ID NO: 329 - protein, 118 aa, Artificial Sequence
  VH
QVQLVQSGTEVKKPGASVKVSCKGSGYTFTDYVMHWVRQAPGQGMEWMGLIRTYSGGVSYNQKFRERATMTVDKSISTAYMELSRLRSDDTAVYYCAKSGTVRGFAYWGQGTLVTVSS

SEQ ID NO: 330 - protein, 118 aa, Artificial Sequence
  VH
QVQLVQSGAEVKKPGASVKVSCKGSGYTFTDYAMYWVRQAPGQGLEWMGVIRTYSGGLSYNQKFRGRATMTVDKSISTAYMELSRLRSDDTAVYYCAKSGTVRGFAHWGQGTLVTVSS

SEQ ID NO: 331 - protein, 118 aa, Artificial Sequence
  VH
QVQLVQSGAEVKKPGASVKVSCKGSGYTFTDYAMYWVRQAPGQGMEWIGVIRTYSGGVTYNQKFQGRVTMTVDKSISTAYMELSRLRSDDTAVYYCAKSGTVRGFAYWGQGTLVTVSS

SEQ ID NO: 332 - protein, 118 aa, Artificial Sequence
  VH
QVQLVQSGTEVKKPGASVKVSCKGSGYTFTDYAMHWVRQAPGQGLEWIGLIRTYSGGVTYNQKFRERATMTVDKSISTAYMELSRLRSDDTAVYYCAKSGTVRGFAYWGQGTFVTVSS

SEQ ID NO: 333 - protein, 118 aa, Artificial Sequence
  VH Antibody 87
QVQLVQSGAEVKKPGASVKVSCKGSGYTFTGYAMYWVRQAPGQGMEWIGVIRTFSGDLSYNQKFKGRATMTVDTSISTAYMELSRLRSDDTAVYYCAKSGTVRGFAYWGQGTLVTVSS

SEQ ID NO: 334 - protein, 118 aa, Artificial Sequence
  VH
QVQLVQSGAEVKKPGASVKVSCKASGYTFTEYAMYWVRQAPGQGMEWMGVIRTYSGEVSYNQKFRDRVTMTVDKSISTAYMELSRLRSDDTAVYYCAKSGTVRGFAYWGQGTLVTVSS

SEQ ID NO: 335 - protein, 118 aa, Artificial Sequence
  VH
QVQLVQSGAEVKKPGASVKVSCKGSGYTFTEYAMHWVRQAPGQGMEWIGLIRTFSGDVTYNQKFQDRATMTVDKSISTAYMELSRLRSDDTAVYYCAKSGTVRGFAYWGQGTLVTVSS

SEQ ID NO: 336 - protein, 118 aa, Artificial Sequence
  VH Antibody 88
QVQLVQSGAEVKKPGASVKVSCKGSGYTFTEYAMHWVRQAPGQGLEWMGVIRTYSGDVSYNQKFRGRATMTVDKSISTAYMELSRLRSDDTAVYYCAKSGTVRGFAYWGQGTLVTVSS

SEQ ID NO: 337 - protein, 118 aa, Artificial Sequence
  VH
QVQLVQSGTEVKKPGASVEVSCKGSGYTFTDYAMHWVRQAPGQGLEWIGLIRTFSGDVSYNQKFRGRATMTVDKSISTAYMELSRLRSDDTAVYYCAKSGTVRGFAYWGQGTLVTVSS

SEQ ID NO: 338 - protein, 118 aa, Artificial Sequence
  VH Antibody 89
QVQLVQSGTEVKKPGASVKVSCKASGYTFTGYAMYWVRQAPGQGMEWMGVIRTFSGDVTYNQKFRGRVTMTVDKSISTAYMELSRLRSDDTAVYYCAKSGTVRGFAYWGQGTLVTVSS

SEQ ID NO: 339 - protein, 118 aa, Artificial Sequence
  VH Antibody 90
QVQLVQSGAEVKKPGASVKVSCKASGYTFTEYAMYWVRQAPGQGLEWIGLIRTYSGDLSYNQKFKERATMTVDTSISTAYMELSRLRSDDTAVYYCAKSGTVRGFAYWGQGTLVTVSS

SEQ ID NO: 340 - protein, 118 aa, Artificial Sequence
  VH Antibody 91
QVQLVQSGTEVKKPGASVKVSCKGSGYTFTEYAMHWVRQAPGQGMEWMGLIRTYSGGVSYNQKFQERATMTVDTSISTAYMELSRLRSDDTAVYYCAKSGTVRGFAYWGQGTLVTVSS

SEQ ID NO: 341 - protein, 118 aa, Artificial Sequence
  VH
QVQLVQSGAEVKKPGASVKVSCKGSGYTFTGYAMYWVRQAPGQGLEWIGLIRTYSGEVSYNQKFQGRATMTVDKSISTAYMELSRLRSDDTAVYYCAKSGTVRGFAYWGQGTLVTVSS

SEQ ID NO: 342 - protein, 118 aa, Artificial Sequence
  VH Antibody 92
QVQLVQSGAEVKKPGASVKVSCKGSGYTFTEYAMYWVRQAPGQGLEWMGLIRTFSGGVTYNQKFQGRATMTVDTSISTAYMELSRLQSDDTAVYYCAKSGTVRGFAYWGQGTLVTVSS

SEQ ID NO: 343 - protein, 118 aa, Artificial Sequence
  VH Antibody 93
QVQLVQSGTEVKKPGASVKVSCKASGYTFTDYAMHWVRQAPGQGMEWMGVIQTYSGDVSYNQKFQGRVTMTVDKSISTAYMELSRLRSDDTAVYYCAKSGTVRGFAYWGQGTLVTVSS

SEQ ID NO: 344 - protein, 118 aa, Artificial Sequence
  VH
QVQLVQSGAEVKKPGASVKVSCKGSGYTFTDYAMHWVRQAPGQGMEWMGLIRTYSGDLSYNQKFRGRVTMTVDKSISTAYMELSRLRSDDTAVYYCAKSGTVRGFAYWGQGTLVTVSS

SEQ ID NO: 345 - protein, 118 aa, Artificial Sequence
  pab1979, VH; pab1980, VH; pab1981, VH
QVQLVQSGAEVKKPGASVKVSCKASGYTFTEYAMHWVRQAPGQGLEWMGVIRTYSGGVSYNQKFQERVTMTVDTSISTAYMELSRLRSDDTAVYYCAKSGTVRGFAYWGQGTLVTVSS

SEQ ID NO: 346 - protein, 118 aa, Artificial Sequence
  VH
QVQLVQSGTEVKKPGASVKVSCKGSGYTFTEYAMYWVRQAPGQGLEWMGLIKTYSGDVSYNQKFRERVTMTVDKNISTAYMELSRLRSDDTAVYYCAKSGTVRGFAYWGQGTLVTVSS

SEQ ID NO: 347 - protein, 118 aa, Artificial Sequence
  VH
QVQLVQSGAEVKKPGASVKVSCKASGYTFTDYAMYWVRQAPGQGMEWMGLIRTYSGGVSYNQKFKGRATMTVDTSISTAYMELSRLRSDDTAVYYCAKSGTVRGFAYWGQGTLVTVSS

SEQ ID NO: 348 - protein, 118 aa, Artificial Sequence
  VH
QVQLVQSGAEVKKPGASVKVSCKGSGYTFTGYAMYWVRQAPGQGLEWIGVIRTYSGDVSYNQKFQDRATMTVDTSISTAYMELSRLRSDDTAVYYCAKSGTVRGFAYWGQGTLVTVSS

SEQ ID NO: 349 - protein, 118 aa, Artificial Sequence
  VH
QVQLVQSGTEVKKPGASVKVSCKGSGYTFTDYAMYWVRQAPGQGLEWMGVIRTFSGGLTYNQKFRGRVTMTVDTSISTAYMELSRLRSDDTAVYYCAKSGTVRGFAYWGQGTLVTVSS

SEQ ID NO: 350 - protein, 118 aa, Artificial Sequence
  VH Antibody 94
QVQLVQSGTEVKKPGASVKVSCKGSGYTFTGYAMYWVRQAPGQGLEWIGVIRTFSGGVTYNQKFRDRVTMTVDKSISTAYMELSRLRSDDTAVYYCAKSGTVRGFAYWGQGTFVTVSS

SEQ ID NO: 351 - protein, 118 aa, Artificial Sequence
  VH
QVRLVQSGTEVKKPGASVKVSCKGSGYTFTGYAMYWVRQAPGQGMEWMGVIRTFSGDVTYNQKFKERATMTVDTSISTAYMELSRLRSDDTAVYYCAKSGTVRGFAYWGQGTLVTVSS

SEQ ID NO: 352 - protein, 118 aa, Artificial Sequence
  VH
QVQLVQSGAEVKKPGASVKVSCKGSGYTFTGYAMHWVRQAPGQGLEWMGLIRTYSGGVSYNQKFRERATMTVDKSISTAYMELSRLRSDDTAVYYCAKSGTVRGFAYWGQGTLVTVSS

SEQ ID NO: 353 - protein, 118 aa, Artificial Sequence
  VH
QVQLVQSGAEVKKPGASVKVSCKGSGYTFTDYAMYWVRQAPGQGMEWIGLIRTFGGDVTYNQKFRGRVTMTVDTSISTAYMELSRLRSDDTAVYYCAKSGTVRGFAYWGQGTLVTVSS

SEQ ID NO: 354 - protein, 118 aa, Artificial Sequence
  VH Antibody 95
QVQLVQSGAEVKKPGASVKVSCKGSGYTFTDYAMYWVRQAPGQGLEWMGLIRTYSGGVSYNQKFRGRVTMTVDTSISTAYMELSRLRSDDTAVYYCAKSGTVRGFAYWGQGTFVTVSS

SEQ ID NO: 355 - protein, 118 aa, Artificial Sequence
  VH Antibody 96
QVQLVQSGAEVKKPGASVKVSCKGSGYTFTEYAMYWVRQAPGQGMEWMGVIRTYSGGLTYNQKFRDRVTMTVDTSISTAYMELSRLRSDDTAVYYCAKSGTVRGFAYWGQGTLVTVSS

SEQ ID NO: 356 - protein, 118 aa, Artificial Sequence
  VH Antibody 97
QVQLVQSGTEVKKPGASVKVSCKGSGYTFTEYAMHWVRQAPGQGMEWIGLIRTFSGGLSYNQKFRDRVTMTVDKSISTAYMELSRLRSDDTAVYYCAKSGTVRGFAYWGQGTLVTVSS

SEQ ID NO: 357 - protein, 118 aa, Artificial Sequence
  VH
QVQLVQSGAEVKKPGASVKVSCKGSGYTFTGYAMHWVRQAPGQGMEWMGLIRTFSGGLSYNQKFRDRVTMTVDTSISTAYMELSRLRSDDTAVYYCAKSGTVRGFAYWGQGTLVTVSS

SEQ ID NO: 358 - protein, 118 aa, Artificial Sequence
  VH Antibody 98
QVQLVQSGAEVKKPGASVKVSCKGSGYTFTGYAMHWVRQAPGQGMEWMGVIRTFSGGVSYNQKFQERATMTVDTSISTAYMELSRLRSDDTAVYYCAKSGTVRGFAYWGQGTLVTVSS

SEQ ID NO: 359 - protein, 118 aa, Artificial Sequence
  VH Antibody 99
QVQLVQSGAEVKKPGASVKVSCKASGYTFTDYAMHWVRQAPGQGMEWMGLIRTFSGDLSYNQKFRGRVTMTVDKSISTAYMELSRLRSDDTAVYYCAKSGTVRGFAYWGQGTLVTVSS

SEQ ID NO: 360 - protein, 118 aa, Artificial Sequence
  VH Antibody 100
QVQLVQSGTEVKKPGASVKVSCKASGYTFTEYAMHWVRQAPGQGMEWMGVIRTFSGGVSYNQKFQGRATMTVDTSISTAYMELSRLRSDDTAVYYCAKSGTVRGFAYWGQGTLVTVSS

SEQ ID NO: 361 - protein, 118 aa, Artificial Sequence
  VH
QVQLVQSGAEVKKPGASVKVSCKGSGYTFTEYAMYWVRQAPGQGMEWIGLIRTYSGGVSYNQKFRGRVTMTVDKSISTAYMELSRLRSDDTAVYYCAKSGTVRGFAYWGQGTLVTVSS

SEQ ID NO: 362 - protein, 118 aa, Artificial Sequence
  VH Antibody 101
QVQLVQSGAEVKKPGASVKVSCKASGYTFTDYAMHWVRQAPGQGLEWMGLIRTFSGGVSYNQKFQDRVTMTVDKSISTAYMELSRLRSDDTAVYYCAKSGTVRGFAYWGQGTLVTVSS

SEQ ID NO: 363 - protein, 118 aa, Artificial Sequence
  VH Antibody 102
QVQLVQSGTEVKKPGASVKVSCKASGYTFTGYAMYWVRQAPGQGLEWIGVIRTYSGGVSYNQKFRDRVTMTVDTSISTAYMELSRLRSDDTAVYYCAKSGTVRGFAYWGQGTLVTVSS

SEQ ID NO: 364 - protein, 118 aa, Artificial Sequence
  VH Antibody 103
QVQLVQSGAEVKKPGASVKVSCKASGYTFTGYAMYWVRQAPGQGMEWMGVIRTYSGDVSYNQKFRGRVTMTVDTSISTAYMELSRLRSDDTAVYYCAKSGTVRGFAYWGQGTLVTVSS

SEQ ID NO: 365 - protein, 118 aa, Artificial Sequence
  VH Antibody 104
QVQLVQSGTEVKKPGASVKVSCKGSGYTFTDYAMYWVRQAPGQGMEWMGLIRTFSGGVSYNQKFRDRVTMTVDTSISTAYMELSRLRSDDTAVYYCAKSGTVRGFAYWGQGTLVTVSS

SEQ ID NO: 366 - protein, 118 aa, Artificial Sequence
  VH Antibody 105
QVQLVQSGAEVKKPGASVKVSCKGSGYTFTEYAMYWVRQAPGQGLEWMGLIRTFSGGVSYNQKFKGRVTMTVDTSISTAYMELSRLRSDDTAVYYCAKSGTVRGFAYWGQGTLVTVSS

SEQ ID NO: 367 - protein, 118 aa, Artificial Sequence
  VH Antibody 106
QVQLVQSGTEVKKPGASVKVSCKGSGYTFTDYAMYWVRQAPGQGLEWIGVIRTFSGDVSYNQKFQERATMTVDKSISTAYMELSRLRSDDTAVYYCAKSGTVRGFAYWGQGTLVTVSS

SEQ ID NO: 368 - protein, 118 aa, Artificial Sequence
  VH Antibody 107
QVQLVQSGAEVKKPGASVKVSCKGSGYTFTGYAMYWVRQAPGQGLEWMGVIRTYSGDVSYNQKFRDRVTMTVDTSISTAYMELSRLRSDDTAVYYCAKSGTVRGFAYWGQGTLVTVSS

SEQ ID NO: 369 - protein, 118 aa, Artificial Sequence
  VH
QVQLVQSGAEVKKPGASVKVSCKASGYTFTEYAMYWVRQAPGQGMEWMGLIRTYSGEVTYNQKFRERATMTVDTSISTAYMELSRLRSDDTAVYYCAKSGTVRGFAYWGQGTLVTVSS

SEQ ID NO: 370 - protein, 118 aa, Artificial Sequence
  VH
QVQLVQSGTEVKKPGASVKVSCKASGYTFTEYAMYWVRQAPGQGLEWIGVIRTFSGGVTYNQKFRGRATMTVDTSISTAYMELSRLRSDDTAVYYCAKSGTVRGFAYWGQGTLVTVSS

SEQ ID NO: 371 - protein, 118 aa, Artificial Sequence
  VH
QVQLVQSGTEVKKPGASVKVSCKASGYTFTGYAMYWVRQAPGQGLEWMGLIRTYSGEVSYNQKFQDRVTMTVDTSISTAYMELSRLRSDDTAVYYCAKSGTVRGFAYWGQGTLVTVSS

SEQ ID NO: 372 - protein, 118 aa, Artificial Sequence
  VH
QVQLVQSGAEVKKPGASVKVSCKASGYTFTEYAMYWVRQAPGQGLEWMGLIRTFSGGVSYNQKFRGRVTMTVDTSISTAYMELSRLRSDDTAVYYCAKSGTVRGFAYWGQGTLVTVSS

SEQ ID NO: 373 - protein, 118 aa, Artificial Sequence
  VH
QVQLVQSGTEVKKPGASVKVSCKGSGYTFTEYAMYWVRQAPGQGLEWMGVIRTFSGGVSYNQKFRGRVTMTVDTSISTAYMELSRLRSDDTAVYYCAKSGTVRGFAYWGQGTLVTVSS

SEQ ID NO: 374 - protein, 118 aa, Artificial Sequence
  VH
QVQLVQSGTEVKKPGASVKVSCKASGYTFTDYAMYWVRQAPGQGMEWMGVIKTFSGGVTYNQKFRGRVTMTVDTSISTAYMELSRLRSDDTAVYYCAKSGTVRGFAYWGQGTLVTVSS

SEQ ID NO: 375 - protein, 118 aa, Artificial Sequence
  VH
QVQLVQSGAEVKKPGASVKVSCKASGYTFTGYAMYWVRQAPGQGMEWMGVIRTFSGDVTYNQKFRERATMTVDKSISTAYMELSRLRSDDTAVYYCAKSGTVRGFAYWGQGTLVTVSS

SEQ ID NO: 376 - protein, 118 aa, Artificial Sequence
  VH
QVQLVQSGTEVKKPGASVKVSCKASGYTFTEYAMYWVRQAPGQGLEWIGVIRTFSGDVSYNQKFKGRATMTVDTSISTAYMELSRLRSDDTAVYYCAKSGTVRGFAYWGQGTLVTVSS

SEQ ID NO: 377 - protein, 118 aa, Artificial Sequence
  VH
QVQLVQSGTEVKKPGASVKVSCKGSGYTFTDYAMYWVRQAPGQGLEWMGLIRTYSGDVSYNQKFQDRVTMTVDTSISTAYMELSRLRSDDTAVYYCAKSGTVRGFAYWGQGTLVTVSS

SEQ ID NO: 378 - protein, 118 aa, Artificial Sequence
  VH
QVQLVQSGAEVKKPGASVKVSCKGSGYTFTEYAMYWVRQAPGQGLEWMGVIKTFSGGVSYNQKFRGRVTMTVDTSISTAYMELSRLRSDDTAVYYCAKSGTVRGFAHWGQGTLVTVSS

SEQ ID NO: 379 - protein, 118 aa, Artificial Sequence
  VH
QVQLVQSGTEVKKPGASVKVSCKGSGYTFTDYAMYWVRQAPGQGLEWMGLIRTYSGDVSYNQKFRGRVTMTVDKSISTAYMELSRLRSDDTAVYYCAKSGTVRGFAYWGQGTLVTVSS

SEQ ID NO: 380 - protein, 118 aa, Artificial Sequence
  VH
QVQLVQSGTEVKKPGASVKVSCKGSGYTFTEYAMYWVRQAPGQGLEWIGVIRTYSGEVSYNQKFRGRVTMTVDTSISTAYMELSRLRSDDTAVYYCAKSGTVRGFAYWGQGTLVTVSS

SEQ ID NO: 381 - protein, 118 aa, Artificial Sequence
  VH
QVQLVQSGAEVKKPGASVKVSCKGSGYTFTDYAMYWVRQAPGQGLEWIGVIQTFSGGLTYNQKFQDRVTMTVDKSISTAYMELSRLRSDDTAVYYCAKSGTVRGFAYWGQGTLVTVSS

SEQ ID NO: 382 - protein, 118 aa, Artificial Sequence
  VH
QVQLVQSGAEVKKPGASVKVSCKASGYTFTEYAMYWVRQAPGQGLEWIGVIKTFSGGVSYNQKFQGRVTMTVDTSISTAYMELSRLRSDDTAVYYCAKSGTVRGFAYWGQGTLVTVSS

SEQ ID NO: 383 - protein, 118 aa, Artificial Sequence
  VH
QVQLVQSGTEVKKPGASVKVSCKASGYTFTDYAMYWVRQAPGQGLEWMGLIRTFSGDVTYNQKFRGRVTMTVDKSISTAYMELSRLRSDDTAVYYCAKSGTVRGFAYWGQGTLVTVSS

SEQ ID NO: 384 - protein, 118 aa, Artificial Sequence
  VH
QVQLVQSGAEVKKPGASVKVSCKGSGYTFTDYAMYWVRQAPGQGLEWIGLIRTYSGDVSYNQKFRDRVTMTVDKSISTAYMELSRLRSDDTAVYYCAKSGTVRGFAYWGQGTLVTVSS

SEQ ID NO: 385 - protein, 118 aa, Artificial Sequence
  VH
QVQLVQSGAEVKKPGASVKVSCKASGYTFTEYAMYWVRQAPGQGLEWMGVIRTFSGGVSYNQKFRGRVIMTVDTSISTAYMELSRLRSDDTAVYYCAKSGTVRGFAYWGQGTLVTVSS

SEQ ID NO: 386 - protein, 118 aa, Artificial Sequence
  VH
QVQLVQSGAEVKKPGASVKVSCKASGYTFTDYAMYWVRQAPGQGLEWIGVIRTYSGDVTYNQKFQERVTMTVDKSISTAYMELSRLRSDDTAVYYCAKSGTVRGFAYWGQGTLVTVSS

SEQ ID NO: 387 - protein, 118 aa, Artificial Sequence
  VH
QVQLVQSGAEVKKPGASVKVSCKGSGYTFTDYAMYWVRQAPGQGLEWIGVIRTYSGEVSYNQKFQGRVTMTVDTSISTAYMELSRLRSDDTAVYYCAKSGTVRGFAYWGQGTLVTVSS

SEQ ID NO: 388 - protein, 118 aa, Artificial Sequence
  VH
QVQLVQSGAEVKKPGASVKVSCKASGYTFTEYAMYWVRQAPGQGMEWMGVIRTYSGNVSYNQKFKGRVTMTVDTSISTAYMELSRLRSDDTAVYYCAKSGTVRGFAYWGQGTLVTVSS

SEQ ID NO: 389 - protein, 118 aa, Artificial Sequence
  VH
QVQLVQSGAEVKKPGASVKVSCKGSGYTFTEYAMYWVRQAPGQGLEWMGVIRTYSGDVSYNQKFQDRVTMTVDTSISTAYMELSRLRSDDTAVYYCAKSGTVRGFAYWGRGTLVTVSS

SEQ ID NO: 390-399 - skipped (10 entries)

SEQ ID NO: 400 - protein, 113 aa, Artificial Sequence
  VL Antibody 1
DIVMTQSPDSLAVSLGERATINCKSSQSLLNSGNQKNYLTWYHQKPGQPPKMLIYWASTRESGVPDRFSGSGSGTDFTLTISSVQAEDVAVYHCQNDYSYPYTFGQGTKLEIK

SEQ ID NO: 401 - protein, 113 aa, Artificial Sequence
  VL Antibody 2
DIVMTQSPDSLAVSLGERATINCKSSQSLLNSGNQKNYLSWYHQKPGQPPKLLIYWASTRESGVPDRFSGSGSGTDFTLTISSVQAEDVAVYYCQNEYSFPYTFGQGTKLEIK

SEQ ID NO: 402 - protein, 113 aa, Artificial Sequence
  VL Antibody 3
DIVMTQSPDSLAVSLGERATINCKSSQSLLNSGNQKNYLSWYHQKPGQPPKLLIYWASTRESGVPDRFTGSGSGTDFTLTISSVQAEDVAVYHCQNDYSFPYTFGQGTKLEIK

SEQ ID NO: 403 - protein, 113 aa, Artificial Sequence
  VL Antibody 4
DIVMTQSPDSLAVSLGERATINCKSSQSLLNSSNQKNYLSWYHQKPGQPPKLLIYWASTRESGVPDRFTGSGSGTDFTLTISSVQAEDVAVYYCQNDYSYPYTFGQGTKLEIK

SEQ ID NO: 404 - protein, 112 aa, Artificial Sequence
  VL Antibody 5
DIVMTQSPDSLAAPGERATINCKSSQSLLNSSNQKNYLTWYHQKPGQPPKLLIYWASTRESGVPDRFTGSGSGTDFTLTISSVQAEDVAVYYCQNEYSFPYTFGQGTKLEIK

SEQ ID NO: 405 - protein, 113 aa, Artificial Sequence
  VL Antibody 6
DIVMTQSPDSLAVSLGERATINCKSSQSLLNSGNQKNYLSWYQQKPGQPPKMLIYWASTRESGVPDRFTGSGSGTDFTLTISSLQAEDVAVYHCQNDYSYPYTFGQGTKLEIK

SEQ ID NO: 406 - protein, 113 aa, Artificial Sequence
  VL Antibody 7
DIVMTQSPDSLAVSLGERATINCKSSQSLLNSSNQKNYLSWYHQKPGQPPKMLIYWASTRESGVPDRFSGSGSGTDFTLTISSLQAEDVAVYHCQNEYSFPYTFGQGTKLEIK

SEQ ID NO: 407 - protein, 113 aa, Artificial Sequence
  Antibody 8
DIVMTQSPDSLAVSLGERATINCKSSQSLLNSGNQKNYLTWYHQKPGQPPKLLIYWASTRESGVPDRFSGSGSGTDFTLTISSVQAEDVAVYHCQNEYSYPYTFGQGTKLEIK

SEQ ID NO: 408 - protein, 113 aa, Artificial Sequence
  VL Antibody 9
DIVMTQSPDSLAVSLGERATINCKSSQSLLNSGNQKNYLTWYQQKPGQPPKMLIYWASTRESGVPDRFSGSGSGTDFTLTISSLQAEDVAVYHCQNDYSFPYTFGQGTKLEIK

SEQ ID NO: 409 - protein, 113 aa, Artificial Sequence
  VL Antibody 10
DIVMTQSPDSLAVSLGERATINCKSSQSLLNSSNQKNYLSWYQQKPGQPPKLLIYWASTRESGVPDRFSGSGSGTDFTLTISSVQAEDVAVYHCQNDYSYPYTFGQGTKLEIK

SEQ ID NO: 410 - protein, 113 aa, Artificial Sequence
  VL Antibody 11
DIVMTQSPDSLAVSLGERATINCKSSQSLLNSSNQKNYLSWYQQKPGQPPKLLIYWASTRESGVPDRFSGSGSGTDFTLTISSVQAEDVAVYHCQNDYSFPYTFGQGTKLEIK

SEQ ID NO: 411 - protein, 113 aa, Artificial Sequence
  VL Antibody 12
DIVMTQSPDSLAVSLGERATINCKSSQSLLNSGNQKNYLSWYHQKPGQPPKMLIYWASTRESGVPDRFSGSGSGTDFTLTISSLQAEDVAVYHCQNDYSFPYTFGQGTKLEIK

SEQ ID NO: 412 - protein, 113 aa, Artificial Sequence
  VL
DIVMTQSPDSLAVSLGERATINCKSSQSLLNSGNQKNYLTWYHQKPGQPPKMLIYWASTRESGVPDRFSGSGSGTDFTLTISSVQAEDVAVYYCQNDYSYPYTFGQGTKLEIK

SEQ ID NO: 413 - protein, 113 aa, Artificial Sequence
  VL Antibody 13
DIVMTQSPDSLAVSLGERATINCKSSQSLLNSSNQKNYLTWYQQKPGQPPKLLIYWASTRESGVPDRFSGSGSGTDFTLTISSVQAEDVAVYHCQNDYSFPYTFGQGTKLEIK

SEQ ID NO: 414 - protein, 113 aa, Artificial Sequence
  VL Antibody 14
DIVMTQSPDSLAVSLGERATINCKSSQSLLNSGNQKNYLSWYHQKPGQPPKMLIYWASTRESGVPDRFSGSGSGTDFTLTISSVQAEDVAVYYCQNDYSYPYTFGQGTKLEIK

SEQ ID NO: 415 - protein, 113 aa, Artificial Sequence
  VL Antibody 15
DIVMTQSPDSLAVSLGERATINCKSSQSLLNSGNQKNYLSWYQQKPGQPPKLLIYWASTRESGVPDRFTGSGSGTDFTLTISSLQAEDVAVYHCQNDYSYPYTFGQGTKLEIK

SEQ ID NO: 416 - protein, 113 aa, Artificial Sequence
  VL Antibody 16
DIVMTQSPDSLAVSLGERATINCKSSQSLLNSGNQKNYLTWYHQKPGQPPKLLIYWASTRESGVPDRFTGSGSGTDFTLTISSVQAEDVAVYHCQNDYSYPYTFGQGTKLEIK

SEQ ID NO: 417 - protein, 113 aa, Artificial Sequence
  VL
DIVMTQSPDSLAVSLGERATINCKSSQSLLNSSNQKNYLSWYHQKPGQPPKLLIYWASTRESGVPDRFTGSGSGTDFTLTISSVQAEDVAVYHCQNDYSFPYTFGQGTKLEIK

SEQ ID NO: 418 - protein, 113 aa, Artificial Sequence
  VL Antibody 17
DIVMTQSPDSLAVSLGERATINCKSSQSLLNSGNQKNYLSWYHQKPGQPPKMLIYWASTRESGVPDRFSGSGSGTDFTLTISSVQAEDVAVYHCQNEYSFPYTFGQGTKLEIK

SEQ ID NO: 419 - protein, 113 aa, Artificial Sequence
  VL Antibody 18
DIVMTQSPDSLAVSLGERATINCKSSQSLLNSSNQKNYLTWYHQKPGQPPKMLIYWASTRESGVPDRFTGSGSGTDFTLTISSVQAEDVAVYYCQNDYSYPYTFGQGTKLEIK

SEQ ID NO: 420 - protein, 113 aa, Artificial Sequence
  VL Antibody 19
DIVMTQSPDSLAVSLGERATINCKSSQSLLNSSNQKNYLSWYQQKPGQPPKLLIYWASTRESGVPDRFTGSGSGTDFTLTISSVQAEDVAVYHCQNDYSFPYTFGQGTKLEIK

SEQ ID NO: 421 - protein, 113 aa, Artificial Sequence
  VL Antibody 20
DIVMTQSPDSLAVSLGERATINCKSSQSLLNSGNQKNYLTWYQQKPGQPPKMLLYWASTRESGVPDRFTGSGSGTDFTLTISSVQAEDVAVYHCQNDYSYPYTFGQGTKLEIK

SEQ ID NO: 422 - protein, 113 aa, Artificial Sequence
  VL
DIVMTQSPDSLAVSLGERATINCKSSQSLLNSGNQKNYLTWYQQKPGQPPKLLIYWASTRESGVPDRFTGSGSGTDFTLTISSVQAEDVAVYHCQNDYSFPYTFGQGTKLEIK

SEQ ID NO: 423 - protein, 113 aa, Artificial Sequence
  VL Antibody 21
DIVMTQSPDSLAVSLGERATINCKSSQSLLNSGNQKNYLTWYHQKPGQPPKLLIYWASTRESGVPDRFSGSGSGTDFTLTISSVQAEDVAVYHCQNDYSYPYTFGQGTKLEIK

SEQ ID NO: 424 - protein, 113 aa, Artificial Sequence
  VL Antibody 22
DIVMTQSPDSLAVSLGERATINCKSSQSLLNSGNQKNYLSWYHQKPGQPPKMLIYWASTRESGVPDRFSGSGSGTDFTLTISSVQAEDVAVYHCQNDHSFPYTFGQGTKLEIK

SEQ ID NO: 425 - protein, 113 aa, Artificial Sequence
  VL Antibody 23
DIVMTQSPDSLAVSLGERATINCKSSQSLLNSGNQKNYLSWYQQKPGQPPKMLIYWASTRESGVPDRFSGSGSGTDFTLTISSVQAEDVAVYHCQNDYSSPYTFGQGTKLEIK

SEQ ID NO: 426 - protein, 113 aa, Artificial Sequence
  VL Antibody 24
DIVMTQSPDSLAVSLGERATINCKSSQSLLNSSNQKNYLTWYQQKPGQPPKMLIYWASTRESGVPDRFSGSGSGTDFTLTISSVQAEDVAVYHCQNDYSFPYTFGQGTKLEIK

SEQ ID NO: 427 - protein, 113 aa, Artificial Sequence
  VL Antibody 25
DIVMTQSPDSLAVSLGERATINCKSSQSLLNSGNQKNYLTWYQQKPGQPPKMLIYWASTRESGVPDRFTGSGSGTDFTLTISSVQAEDVAVYYCQNDYSFPYTFGQGTKLEIK

SEQ ID NO: 428 - protein, 113 aa, Artificial Sequence
  VL Antibody 26
DIVMTQSPDSLAVSLGERATINCKSSQSLLNSGNQKNYLTWYQQKPGQPPKMLIYWASTRESGVPDRFSGSGSGTDFTLTISSVQAEDVAVYYCQNEYSFPYTFGQGTKLEIK

SEQ ID NO: 429 - protein, 113 aa, Artificial Sequence
  VL Antibody 27
DIVMTQSPDSLAVSLGERATINCKSSQSLLNSSNQKNYLSWYHQKPGQPPKLLIYWASTRESGVPDRFSGSGSGTDFTLTISSLQAEDVAVYHCQNDYSFPYTFGQGTKLEIK

SEQ ID NO: 430 - protein, 113 aa, Artificial Sequence
  VL Antibody 28
DIVMTQSPDSLAVSLGERATINCKSSQSLLNSGNQKNYLSWYHQKPGQPPKLLIYWASTRESGVPDRFSGSGSGTDFTLTISSLQAEDVAVYHCQNDYSFPYTFGQGTKLEIK

SEQ ID NO: 431 - protein, 113 aa, Artificial Sequence
  VL Antibody 29
DIVMTQSPDSLAVSLGERATINCKSSQSLLNSSNQKNYLSWYQQKPGQPPKLLIYWASTRESGVPDRFSGSGSGTDFTLTISSLQAEDVAVYHCQNDYSYPYTFGQGTKLEIK

SEQ ID NO: 432 - protein, 113 aa, Artificial Sequence
  VL Antibody 30
DIVMTQSPDSLAVSLGERATINCKSSQSLLNSGNQKNYLSWYHQKPGQPPKLLIYWASTRESGVPDRFSGSGSGTDFTLTISSLQAEDVAVYYCQNDYSYPYTFGQGTKLEIK

SEQ ID NO: 433 - protein, 113 aa, Artificial Sequence
  VL Antibody 31
DIVMTQSPDSLAVSLGERATINCKSSQSLLNSSNQKNYLTWYQQKPGQPPKLLIYWASTRESGVPDRFTGSGSGTDFTLTISSLQAEDVAVYHCQNDYSYPYTFGQGTKLEIK

SEQ ID NO: 434 - protein, 113 aa, Artificial Sequence
  VL Antibody 32
DIVMTQSPDSLAVSLGERATINCKSSQSLLNSGNQKNYLTWYQQKPGQPPKLLIYWASTRESGVPDRFTGSGSGTDFTLTISSLQAEDVAVYHCQNDYSYPYTFGQGTKLEIK

SEQ ID NO: 435 - protein, 113 aa, Artificial Sequence
  VL Antibody 33
DIVMTQSPDSLAVSLGERATINCKSSQSLLNSGNQKNYLSWYHQKPGQPPKLLIYWASTRESGVPDRFSGSGSGTDFTLTISSVQAEDVAVYHCQNEYSYPYTFGQGTKLEIK

SEQ ID NO: 436 - protein, 113 aa, Artificial Sequence
  VL Antibody 34
DIVMTQSTDSLAVSLGERATINCKSSQSLLNSSNQKNYLTWYQQKPGQPPKLLIYWASTRESGVPDRFTGSGSGTDFTLTISSLQAEDVAVYHCQNDYSYPYTFGQGTKLEIK

SEQ ID NO: 437 - protein, 113 aa, Artificial Sequence
  VL Antibody 35
DIVMTQSPDSLAVSLGERATINCKSSQSLLNSGNQKNYLTWYHQKPGQPPKLLIYWASTRESGVPDRFTGSGSGTDFTLTISSVQAEDVAVYYCQNDYSYPYTFGQGTKLEIK

SEQ ID NO: 438 - protein, 113 aa, Artificial Sequence
  VL Antibody 36
DIVMTQSPDSLAVSLGERATINCKSSQSLLNSSNQKNYLTWYHQKPGQPPKMLIYWASTRESGVPDRFSGSGSGTDFTLTISSVQEEDVAVYHCQNDYSFPYTFGQGTKLEIK

SEQ ID NO: 439 - protein, 113 aa, Artificial Sequence
  VL Antibody 37
DIVMTQSPDSLAVSLGERATINCKSSQSLLNSGNQKNYLTWYQQKPGQPPKLLIYWASTRESGVPDRFTGSGSGTDFTLTISSLQAEDVAVYHCQNEYSYPYTFGQGTKLEIK

SEQ ID NO: 440 - protein, 113 aa, Artificial Sequence
  VL Antibody 38
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPYTFGQGTKLEIK

SEQ ID NO: 441 - protein, 113 aa, Artificial Sequence
  VL Antibody 39
DIVMTQSPDSLAVSLGERATINCKSSQSLLNSSNQKNYLTWYQQKPGQPPKLLIYWASTRESGVPDRFTGSGSGTDFTLTISSVQAEDVAVYHCQNEYSFPYTFGQGTKLEIK

SEQ ID NO: 442 - protein, 113 aa, Artificial Sequence
  VL Antibody 40
DIVMTQSPDSLAVSLGERATINCKSSQSLLNSGNQKNYLSWYQQKPGQPPKLLIYWASTRESGVPDRFTGSGSGTDFTLTISSVQAEDVAVYHCQNEYSYPYTFGQGTKLEIK

SEQ ID NO: 443 - protein, 113 aa, Artificial Sequence
  VL Antibody 41
DIVMTQSPDSLAVSLGERATINCKSSQSLLNSGNQKNYLTWYHQKPGQPPKLLIYWASTRESGVPDRFSGSGSGTDFTLTISSLQAEDVAVYHCQNDYSYPYTFGQGTKLEIK

SEQ ID NO: 444 - protein, 113 aa, Artificial Sequence
  VL Antibody 42
DIVMTQSPDSLAVSLGERATINCKSSQSLLNSGNQKNYLSWYQQKPGQPPKLLIYWASTRESGVPDRFSGSGSGTDFTLTISSLQAEDVAVYYCQNDYSYPYTFGQGTKLEIK

SEQ ID NO: 445 - protein, 113 aa, Artificial Sequence
  VL Antibody 43
DIVMTQSPDSLAVSLGERATINCKSSQSLLNSGNQKNYLTWYQQKPGQPPKMLIYWASTRESGVPDRFTGSGSGTDFTLTISSVQAEDVAVYHCQNDYSYPYTFGQGTKLEIK

SEQ ID NO: 446 - protein, 113 aa, Artificial Sequence
  VL Antibody 44
DIVMTQSPDSLAVSLGERATINCKSSQSLLNSGNQKNYLTWYHQKPGQPPKMLIYWASTRESGVPDRFTGSGSGTDFTLTISSVQAEDVAVYYCQNEYSFPYTFGQGTKLEIK

SEQ ID NO: 447 - protein, 113 aa, Artificial Sequence
  VL Antibody 45
DIVMTQSPDSLAVSLGERATINCKSSQSLLNSGNQKNYLSWYHQKPGQPPKLLIYWASTRESGVPDRFTGSGSGTDFTLTISSVQAEDVAVYYCQNDYSFPYTFGQGTKLEIK

SEQ ID NO: 448 - protein, 113 aa, Artificial Sequence
  VL Antibody 46
DIVMTQSPDSLAVSLGERATINCKSSQSLLNSGNQKNYLSWYHQKPGQPPKLLIYWASTRESGVPDRFTGSGSGTDFTLTISSLQAEDVAVYHCQNDYSYPYTFGQGTKLEIK

SEQ ID NO: 449 - protein, 113 aa, Artificial Sequence
  VL
DIVMTQSPDSLAVSLGERATINCKSSQSLLNSSNQKNYLTWYHQKPGQPPKLLIYWASTRESGVPDRFSGSGSGTDFTLTISSVQAEDVAVYHCQNDYSYPYTFGQGTKLEIK

SEQ ID NO: 450 - protein, 113 aa, Artificial Sequence
  VL Antibody 47
DIVMTQSPDSLAVSLGERATINCKSSQSLLNSGNQKNYLSWYQQKPGQPPKLLIYWASTRESGVPDRFTGSGSGTDFTLTISSVQAEDVAVYHCQNDYSFPYTFGQGTKLEIK

SEQ ID NO: 451 - protein, 113 aa, Artificial Sequence
  VL Antibody 48
DIVMTQSPDSLAVSLGERATINCKSSQSLLNSGNQKNYLSWYQQKPGQPPKLLIYWASTRESGVPDRFTGSGSGTDFTLTISSLQAEDVAVYHCQNEYSFPYTFGQGTKLEIK

SEQ ID NO: 452 - protein, 113 aa, Artificial Sequence
  VL Antibody 49
DIVMTQSPDSLAVSLGERATINCKSSQSLLNSGNQKNYLTWYHQKPGQPPKLLIYWASTRESGVPDRFSGSGSGTDFTLTISSVQAEDVAVYHCQNDYSFPYTFGQGTKLEIK

SEQ ID NO: 453 - protein, 113 aa, Artificial Sequence
  Synthetic peptide
DIVMTQSPDSLAVSLGERATINCKSSQSLLNSSNQKNYLTWYQQKPGQPPKLLIYWASTRESGVPDRFTGSGSGTDFTLTISSLQAEDVAVYYCQNDYSYPYTFGQGTKLEIK

SEQ ID NO: 454 - protein, 113 aa, Artificial Sequence
  VL Antibody 50
DIVMTQSPDSLAVSLGERATINCKSSQSLLNSSNQKNYLTWYQQKPGQPPKMLIYWASTRESGVPDRFSGSGSGTDFTLTISSLQAEDVAVYYCQNDYSYPYTFGQGTKLEIK

SEQ ID NO: 455 - protein, 113 aa, Artificial Sequence
  VL Antibody 51
DIVMTQSPDSLAVSLGERATINCKSSQSLLNSGNQKNYLTWYHQKPGQPPKLLIYWASTRESGVPDRFSGSGSGTDFTLTISSVQAEDVAVYHCQNDYSSPYTFGQGTKLEIK

SEQ ID NO: 456 - protein, 113 aa, Artificial Sequence
  VL Antibody 52
DIVMTQSPDSLAVSLGERATINCKSSQSLLNSGNQKNYLTWYQQKPGQPPKLLIYWASTRESGVPDRFSGSGSGTDFTLTISSLQAEDVAVYHCQNDYSFPYTFGQGTKLEIK

SEQ ID NO: 457 - protein, 113 aa, Artificial Sequence
  VL Antibody 53
DIVMTQSPDSLAVSLGERATINCKSSQSLLNSGNQKNYLSWYQQKPGQPPKLLIYWASTRESGVPDRFTGSGSGTDFTLTISSVQAEDVAVYHCQNDYSYPYTFGQGTKLEIK

SEQ ID NO: 458 - protein, 113 aa, Artificial Sequence
  VL Antibody 54
DIVMTQSPDSLAVSLGERATINCKSSQSLLNSSNQKNYLTWYQQKPGQPPKLLIYWASTRESGVPDRFTGSGSGTDFTLTISSVQAEDVAVYHCQNDYSFPYTFGQGTKLEIK

SEQ ID NO: 459 - protein, 113 aa, Artificial Sequence
  VL Antibody 55
DIVMTQSPDSLAVSLGERATINCKSSQSLLNSGNQKNYLSWYQQKPGQPPKLLIYWASTRESGVPDRFSGSGSGTDFTLTISSVQAEDVAVYHCQNDYSFPYTFGQGTKLEIK

SEQ ID NO: 460 - protein, 113 aa, Artificial Sequence
  VL Antibody 56
DIVMTQSPDSLAVSLGERATINCKSSQSLLNSSNQKNYLSWYQQKPGQPPKLLIYWASTRESGVPDRFTGSGSGTDFTLTISSLQAEDVAVYHCQNDYSYPYTFGQGTKLEIK

SEQ ID NO: 461 - protein, 113 aa, Artificial Sequence
  VL Antibody 57
DIVMTQSPDSLAVSLGERATINCKSSQSLLNSSNQKNYLSWYHQKPGQPPKMLIYWASTRESGVPDRFSGSGSGTDFTLTISSLQAEDVAVYHCQNDYSYPYTFGQGTKLEIK

SEQ ID NO: 462 - protein, 113 aa, Artificial Sequence
  VL Antibody 58
DIVMTQSPDSLAVSLGERATINCKSSQSLLNSGNQKNYLSWYHQKPGQPPKLLIYWASTRESGVPDRFSGSGSGTDFTLTISSVQAEDVAVYHCQNDYSYPYTFGQGTKLEIK

SEQ ID NO: 463 - protein, 113 aa, Artificial Sequence
  VL Antibody 59
DIVMTQSPDSLAVSLGERATINCKSSQSLLNSSNQKNYLSWYHQKPGQPPKLLIYWASTRESGVPDRFSGSGSGTDFTLTISSVQAEDVAVYHCQNDYSYPYTFGQGTKLEIK

SEQ ID NO: 464 - protein, 113 aa, Artificial Sequence
  VL Antibody 60
DIVMTQSPDSLAVSLGERATINCKSSQSLLNSGNQKNYLTWYHQKPGQPPKLLIYWASTRESGVPDRFSGSGSGTDFTLTISSVQAEDVAVYYCQNEYSYPYTFGQGTKLEIK

SEQ ID NO: 465 - protein, 113 aa, Artificial Sequence
  VL
DIVMTQSPDSLAVSLGERATINCKSSQSLLNSGNQKNYLSWYQQKPGQPPKLLIYWASTRESGVPDRFTGSGSGTDFTLTISSVQAEDVAVYYCQNDYSYPYTFGQGTKLEIK

SEQ ID NO: 466 - protein, 113 aa, Artificial Sequence
  VL
DIVMTQSPDSLAVSLGERATINCKSSQSLLNSSNQKNYLSWYQQKPGQPPKLLIYWASTRESGVPDRFTGSGSGTDFTLTISSVQAEDVAVYHCQNDYSYPYTFGQGTKLEIK

SEQ ID NO: 467 - protein, 113 aa, Artificial Sequence
  VL Antibody 61
DIVMTQSPDSLAVSLGERATINCKSSQSLLNSGNQKNYLSWYQQKPGQPPKLLIYWASTRESGVPDRFSGSGSGTDFTLTISSVQAEDVAVYYCQNDYSFPYTFGQGTKLEIK

SEQ ID NO: 468 - protein, 113 aa, Artificial Sequence
  VL Antibody 62
DIVMTQSPDSLAVSLGERATINCKSSQSLLNSGNQKNYLTWYQQKPGQPPKLLIYWASTRESGVPDRFTGSGSGTDFTLTISSLQAEDVAVYHCQNEYSFPYTFGQGTKLEIK

SEQ ID NO: 469 - protein, 113 aa, Artificial Sequence
  VL Antibody 63
DIVMTQSPDSLAVSLGERATINCKSSQSLLNSGNQKNYLSWYHQKPGQPPKMLIYWASTRESGVPDRFTGSGSGTDFTLTISSVQAEDVAVYHCQNDYSFPYTFGQGTKLEIK

SEQ ID NO: 470 - protein, 113 aa, Artificial Sequence
  VL Antibody 64
DIVMTQSPDSLAVSLGERATINCKSSQSLLNSSNQKNYLSWYHQKPGQPPKLLIYWASTRESGVPDRFSGSGSGTDFTLTISSVQAEDVAVYHCQNEYSYPYTFGQGTKLEIK

SEQ ID NO: 471 - protein, 113 aa, Artificial Sequence
  VL Antibody 65
DIVMTQSPDSLPVSLGERATINCKSSQSLLNSSNQKNYLSWYHQKPGQPPKMLIYWASTRESGVPDRFSGSGSGTDFTLTISFVQAEDVAVYYCQNEYSFPYTFGQGTKLEIK

SEQ ID NO: 472 - protein, 113 aa, Artificial Sequence
  Antibody 66
DIVMTQSPDSLAVSLGERATINCKSSQSLLNSSNQKNYLSWYHQKPGQPPKLLIYWASTRESGVPDRFSGSGSGTDFTLTISSVQAEDVAVYHCQNDYSFPYTFGQGTKLEIK

SEQ ID NO: 473 - protein, 113 aa, Artificial Sequence
  VL Antibody 67
DIVMTQSPDSLAVSLGERATINCKSSQSLLNSGNQKNYLTWYHQKPGQPPKLLIYWASTRESGVPDRFTGSGSGTDFTLTISSVQAEDVAVYYCQNDYSFPYTFGQGTKLEIK

SEQ ID NO: 474 - protein, 113 aa, Artificial Sequence
  VL Antibody 68
DIVMTQSPDSLAVSLGERATINCKSSQSLLNSGNQKNYLTWYQQKPGQPPKMLIYWASTRESGVPDRFTGSGSGTDFTLTISSLQAEDVAVYYCQNDYSYPYTFGQGTKLEIK

SEQ ID NO: 475 - protein, 113 aa, Artificial Sequence
  VL Antibody 69
DIVMTQSPDSLAVSLGERATINCKSSQSLLNSSNQKNYLTWYHQKPGQPPKMLIYWASTRESGVPDRFSGSGSGTDFTLTISSVQAEDVAVYYCQNDYSFPYTFGQGTKLEIK

SEQ ID NO: 476 - protein, 113 aa, Artificial Sequence
  VL Antibody 70
DIVMTQSPDSLAVSLGERATINCKSSQSLLNSGNQKNYLSWYQQKPGQPPKLLIYWASTRESGVPDRFSGSGSGTDFTLTISSLQAEDVAVYHCQNDYSFPYTFGQGTKLEIK

SEQ ID NO: 477 - protein, 113 aa, Artificial Sequence
  VL Antibody 71
DIVMTQSPDSLAVSLGERATINCKSSQSLLNSSNQKNYLTWYQQKPGQPPKLLIYWASTRESGVPDRFTGSGSGTDFTLTISSVQAEDVAVYHCQNDYSYPYTFGQGTKLEIK

SEQ ID NO: 478 - protein, 113 aa, Artificial Sequence
  VL
DIVMTQSPDSLAVSLGERATINCKSSQSLLNSGNQKNYLSWYHQKPGQPPTLLIYWASTRESGVPDRFTGSGSGTDFTLTISSLQAEDVAVYYCQNDYSYPYTFGQGTKLEIK

SEQ ID NO: 479 - protein, 113 aa, Artificial Sequence
  VL
DIVMTQSPDSLAVSLGERATINCKSSQSLLNSGNQKNYLTWYHQKPGQPPKLLIYWASTRESGVPDRFSGSGSGTDFTLTISSVQAEDVAVYYCQNEYSFPYTFGQGTKLEIK

SEQ ID NO: 480 - protein, 113 aa, Artificial Sequence
  VL
DIVMTQSPDSLAVPLGERATINCKSSQSLLNSSNQKNYLTWYQQKPGQPPKLLIYWASTRESGVPDRFSGSGSGTDFTLTISSLQAEDVAVYHCQNEYSYPYTFGQGTKLEIK

SEQ ID NO: 481 - protein, 113 aa, Artificial Sequence
  VL Antibody 72
DIVMTQSPDSLAVSLGERATINCKSSQSLLNSGNQKNYLTWYHQKPGQPPKLLIYWASTRESGVPDRFSGSGSGTDFTLTISSLQAEDVAVYHCQNEYSFPYTFGQGTKLEIK

SEQ ID NO: 482 - protein, 113 aa, Artificial Sequence
  VL Antibody 73
DIVMTQSPDSLAVSLGERATINCKSSQSLLNSGNQKNYLTWYHQKPGQPPKLLIYWASTRESGVPDRFSGSGSGTDFTLTISSLQAEDVAVYHCQNDYSFPYTFGQGTKLEIK

SEQ ID NO: 483 - protein, 113 aa, Artificial Sequence
  VL Antibody 74
DIVMTQSPDSLAVSLGERATINCKSSQSLLNSGNQKNYLSWYHQKPGQPPKMLIYWASTRESGVPDRFSGSGSGTDFTLTISSVQAEDVAVYHCQNDYSYPYTFGQGTKLEIK

SEQ ID NO: 484 - protein, 113 aa, Artificial Sequence
  VL Antibody 75
DIVMTQSPDSLAVSLGERATINCKSSQSLLNSGNQKNYLSWYHQKPGQPPKLLIYWASTRESGVPDRFTGSGSGTDFTLTISSLQAEDVAVYYCQNDYSYPYTFGQGTKLEIK

SEQ ID NO: 485 - protein, 113 aa, Artificial Sequence
  VL Antibody 76
DIVMTQSPDSLAVSLGERATINCKSSQSLLNSGNQKNYLSWYQQKPGQPPKMLIYWASTRESGVPDRFSGSGSGTDFTLTISSVQAEDVAVYHCQNDYSFPYTFGQGTKLEIK

SEQ ID NO: 486 - protein, 113 aa, Artificial Sequence
  VL Antibody 77
DIVMTQSPDSLAVSLGERATINCKSSQSLLNSSNQKNYLTWYHQKPGQPPKLLIYWASTRESGVPDRFTGSGSGTDFTLTISSVQAEDVAVYYCQNDYSFPYTFGQGTKLEIK

SEQ ID NO: 487 - protein, 113 aa, Artificial Sequence
  VL
DIVMTQSPDSLAVSLGERATINCKSSQSLLNSSNQKNYLTWYQQKPGQPPKLLIYWASTRESGVPDRFTGSGSGTDFTLTISSVQAEDVAVYYCQNDYSFPYTFGQGTKLEIK

SEQ ID NO: 488 - protein, 113 aa, Artificial Sequence
  VL Antibody 78
DIVMTQSPDSLAVSLGERATINCKSSQSLLNSGNQKNYLTWYHQKPGQPPKMLIYWASTRESGVPDRFTGSGSGTDFTLTISSVQAEDVAVYHCQNDYSYPYTFGQGTKLEIK

SEQ ID NO: 489 - protein, 113 aa, Artificial Sequence
  VL Antibody 79
DIVMTQSPDSLAVSLGERATINCKSSQSLLNSGNQKNYLTWYHQKPGQPPKMLIYWASTRESGVPDRFSGSGSGTDFTLTISSLQAEDVAVYYCQNDYSYPYTFGQGTKLEIK

SEQ ID NO: 490 - protein, 113 aa, Artificial Sequence
  VL Antibody 80
DIVMTQSPDSLAVSLGERATINCKSSQSLLNSSNQKNYLTWYQQKPGQPPKLLIYWASTRESGVPDRFTGSGSGTDFTLTISSLQAEDVAVYYCQNDYSFPYTFGQGTKLEIK

SEQ ID NO: 491 - protein, 113 aa, Artificial Sequence
  VL Antibody 81
DIVMTQSPDSLSVSLGERATINCKSSQSLLNSSNQKNYLSWYQQKPGQPPKLLIYWASTRESGVPDRFSGSGSGTDFTLTISSVQAEDVAVYHCQNDYSYPYTFGQGTKLEIK

SEQ ID NO: 492 - skipped

SEQ ID NO: 493 - protein, 113 aa, Artificial Sequence
  VL Antibody 83
DIVMTQSPDSLAVSLGERATINCKSSQSLLNSSNQKNYLTWYHQKPGQPPKLLIYWASTRESGVPDRFSGSGSGTDFTLTISSVQAEDVAVYYCQNDYSFPYTFGQGTKLEIK

SEQ ID NO: 494 - protein, 113 aa, Artificial Sequence
  VL Antibody 84
DIVMTQSPDSLAVSLGERATINCKSSQSLLNSSNQKNYLTWYQQKPGQPPKLLIYWASTRESGVPDRFTGSGSGTDFTLTISSLQAEDVAVYHCQNDYSFPYTFGQGTKLEIK

SEQ ID NO: 495 - protein, 113 aa, Artificial Sequence
  VL Antibody 85
DIVMTQSPDSLAVSLGERATINCKSSQSLLNSSNQKNYLSWYHQKPGQPPKLLIYWASTRESGVPDRFSGSGSGTDFTLTISSVQAEDVAVYYCQNDYSYPYTFGQGTKLEIK

SEQ ID NO: 496 - protein, 113 aa, Artificial Sequence
  VL Antibody 86
DIVMTQSPDSLAVSLGERATINCKSSQSLLNSGNQKNYLTWYHQKPGQPPKLLIYWASTRESGVPDRFSGSGSGTDFTLTISSVQAEDVAVYYCQNDYSYPYTFGQGTKLEIK

SEQ ID NO: 497 - protein, 113 aa, Artificial Sequence
  VL Antibody 87
DIVMTQSPDSLAVSLGERATINCKSSQSLLNSGNQKNYLTWYQQKPGQPPKLLIYWASTRESGVPDRFSGSGSGTDFTLTISSVQAEDVAVYHCQNDYSYPYTFGQGTKLEIK

SEQ ID NO: 498 - protein, 113 aa, Artificial Sequence
  VL Antibody 88
DIVMTQSPDSLAVSLGERATINCKSSQSLLNSGNQKNYLTWYQQKPGQPPKLLIYWASTRESGVPDRFSGSGSGTDFTLTISSVQAEDVAVYYCQNDYSFPYTFGQGTKLEIK

SEQ ID NO: 499 - protein, 113 aa, Artificial Sequence
  VL Antibody 89
DIVMTQSPDSLAVSLGERATINCKSSQSLLNSGNQKNYLTWYQQKPGQPPKLLIYWASTRESGVPDRFTGSGSGTDFTLTISSLQAEDVAVYHCQNDYSFPYTFGQGTKLEIK

SEQ ID NO: 500 - protein, 113 aa, Artificial Sequence
  VL Antibody 90
DIVMTQSPDSLAVSLGERATINCKSSQSLLNSGNQKNYLSWYHQKPGQPPKLLIYWASTRESGVPDRFTGSGSGTDFTLTISSLQAEDVAVYHCQNEYSSPYTFGQGTKLEIK

SEQ ID NO: 501 - protein, 113 aa, Artificial Sequence
  VL Antibody 91
DIVMTQSPDSLAVSLGERATINCKSSQSLLNSGNQKNYLSWYQQKPGQPPKLLIYWASTRESGVPDRFSGSGSGTDFTLTISSVQAEDVAVYHCQNEYSFPYTFGQGTKLEIK

SEQ ID NO: 502 - protein, 113 aa, Artificial Sequence
  VL Antibody 92
DIVMTQSPDSLAVSLGERATINCKSSQSLLNSGNQKNYLTWYHQKPGQPPKMLIYWASTRESGVPDRFSGSGSGTNFTLTISSVQAEDVAVYHCQNDYSYPYTFGQGTKLEIK

SEQ ID NO: 503 - protein, 113 aa, Artificial Sequence
  VL Antibody 93
DIVMTQSPDSLAVSLGERATINCKSSQSLLNSSNQKNYLTWYHQKPGQPPKMLIYWASTRESGVPDRFTGSGSGTDFTLTISSLQAEDVAVYHCQNDYSYPYTFGQGTKLEIK

SEQ ID NO: 504 - protein, 113 aa, Artificial Sequence
  VL Antibody 94
DIVMTQSPDSLAVSLGERATINCKSSQSLLNSGNQKNYLTWYQQKPGQPPKLLIYWASTRESGVPDRFTGSGSGTDFTLTISSVQAEDVAVYHCQNDYSYPYTFGQGTKLEIK

SEQ ID NO: 505 - protein, 113 aa, Artificial Sequence
  VL Antibody 95
DIVMTQSPDSLAVSLGERATINCKSSQSLLNSGNQKNYLTWYQQKPGQPPKMLIYWASTRESGVPDRFSGSGSGTDFTLTISSVQAEDVAVYHCQNDYSFPYTFGQGTKLEIK

SEQ ID NO: 506 - protein, 113 aa, Artificial Sequence
  VL Antibody 96
DIVMTQSPDSLAVSLGERATINCKSSQSLLNSSNQKNYLSWYHQKPGQPPKLLIYWASTRESGVPDRFSGSGSGTDFTLTISSLQAEDVAVYHCQNDYSYPYTFGQGTKLEIK

SEQ ID NO: 507 - protein, 113 aa, Artificial Sequence
  VL Antibody 97
DIVMTQSPDSLAVSLGERATINCKSSQSLLNSGNQKNYLTWYHQKPGQPPKLLIYWASTRESGVPDRFTGSGSGTDFTLTISSVQAEDVAVYHCQNEYSFPYTFGQGTKLEIK

SEQ ID NO: 508 - protein, 113 aa, Artificial Sequence
  VL Antibody 98
DIVMTQSPDSLAVSLGERATINCKSSQSLLNSGNQKNYLSWYHQKPGQPPKLLIYWASTRESGVPDRFTGSGSGTDFTLTISSVQAEDVAVYHCQNDYSYPYTFGQGTKLEIK

SEQ ID NO: 509 - protein, 113 aa, Artificial Sequence
  VL Antibody 99
DIVMTQSPDSLAVSLGERATINCKSSQSLLNSGNQKNYLTWYQQKPGQPPKMLIYWASTRESGVPDRFSGSGSGTDFTLTISSVQAEDVAVYYCQNDYSFPYTFGQGTKLEIK

SEQ ID NO: 510 - protein, 113 aa, Artificial Sequence
  VL Antibody 100
DIVMTQSPDSLAVSLGERATINCKSSQSLLNSGNQKNYLSWYHQKPGQPPKMLIYWASTRESGVPDRFSGSGSGTDFTLTISSVQAEDVAVYHCQNDYSSPYTFGQGTKLEIK

SEQ ID NO: 511 - protein, 113 aa, Artificial Sequence
  Antibody 101
DIVMTQSPDSLAVSLGERATINCKSSQSLLNSSNQKNYLTWYHQKPGQPPKLLIYWASTRESGVPDRFSGSGSGTDFTLTISSVQAEDVAVYHCQNDYSFPYTFGQGTKLEIK

SEQ ID NO: 512 - protein, 113 aa, Artificial Sequence
  VL Antibody 102
DIVMTQSPDSLAVSLGERATINCKSSQSLLNSSNQKNYLSWYQQKPGQPPKLLIYWASTRESGVPDRFTGSGSGTDFTLTISSVQAEDVAVYYCQNDYSYPYTFGQGTKLEIK

SEQ ID NO: 513 - protein, 113 aa, Artificial Sequence
  VL Antibody 103
DIVMTQSPDSLAVSLGERATINCKSSQSLLNSSNQKNYLSWYQQKPGQPPKLLIYWASTRESGVPDRFSGSGSGTDFTLTISSLQAEDVAVYHCQNDYSSPYTFGQGTKLEIK

SEQ ID NO: 514 - protein, 113 aa, Artificial Sequence
  VL
DIVMTQSPDSLAVSLGERATINCKSSQSLLNSGNQKNYLSWYHQKPGQPPKLLIYWASTRESGVPDRFTGSGSGTDFTLTISSLQAEDVAVYYCQNEYSFPYTFGQGTKLEIK

SEQ ID NO: 515 - protein, 113 aa, Artificial Sequence
  VL Antibody 104
DIVMTQSPDSLAVSLGERATINCKSSQSLLNSGNQKNYLSWYHQKPGQPPKLLIYWASTRESGVPDRFSGSGSGTDFTLTISSFQAEDVAVYHCQNEYSYPYTFGQGTKLEIK

SEQ ID NO: 516 - protein, 113 aa, Artificial Sequence
  VL Antibody 105
DIVMTQSPDSLAVSLGERATINCKSSQSLLNSGNQKNYLSWYQQKPGQPPKLLIYWASTRESGVPDRFSGSGSGTDFTLTISSVQAEDVAVYYCQNDYSYPYTFGQGTKLEIK

SEQ ID NO: 517 - protein, 113 aa, Artificial Sequence
  Antibody 106
DIVMTQSPDSLAVSLGERATINCKSSQSLLNSSNQKNYLTWYQQKPGQPPKSLIYWASTRESGVPDRFSGSGSGTDFTLTISSVQAEDVAVYHCQNDYSYPYTFGQGTKLEIK

SEQ ID NO: 518 - protein, 113 aa, Artificial Sequence
  VL Antibody 107
DIVMTQSPDSLAVSLGERATINCKSSQSLLNSGNQKNYLSWYHQKPGQPPKLLIYWASTRESGVPDRFTGSGSGTDFTLTISSVQAEDVAVYYCQNDYSYPYTFGQGTKLEIK

SEQ ID NO: 519 - protein, 113 aa, Artificial Sequence
  pab1973, VL
DIVMTQSPDSLAVSLGERATINCKSSQSLLNSSNQKNYLTWYQQKPGQPPKLLIYWASTRESGVPDRFTGSGSDTDFTLTISSVQAEDVAVYHCQNDYSYPYTFGQGTKLEIK

SEQ ID NO: 520-552 - skipped (33 entries)

SEQ ID NO: 553 - protein, 448 aa, Artificial Sequence
  Full-length humanized heavy chain
  MISC_FEATURE (215)..(215): can be Lysine or Arginine
  MISC_FEATURE (357)..(357): can be Aspartic Acid or Glutamic Acid
  MISC_FEATURE (359)..(359): can be Leucine or Methionine
  MISC_FEATURE (432)..(432): can be Glycine or Alanine
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKXVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRXEXTKNQVSLTCLVKGFYPSDIAVEWESNGQPENNYKTTPPVLDSDGSFFLYSKLTVDKSRWQQGNVFSCSVMHEXLHNHYTQKSLSLSPGK

SEQ ID NO: 554 - protein, 445 aa, Artificial Sequence
  Full-length humanized heavy chain
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 555 - protein, 220 aa, Artificial Sequence
  Full-length humanized light chain
  MISC_FEATURE (159)..(159): can be Valine or Alanine
  MISC_FEATURE (197)..(197): can be Leucine or Valine
DIVMTQSPPTLSLSPGERVTLSCKSSQSLLNSGNQKNYLTWYQQKPGQAPRLLIYWASTRESGIPARFSGSGSGTDFTLTISSLQPEDFAVYHCQNDYSYPYTFGQGTKLEIKRTVAAPSVFIFPPSDEQLKSGTASVVCLLNNFYPREAKVQWKVDNXLQSGNSQESVTEQDSKDSTYSLSSTLTLSKADYEKHKXYACEVTHQGLSSPVTKSFNRGEC

SEQ ID NO: 556 - protein, 220 aa, Homo sapiens
  MISC_FEATURE (1)..(220): Full-length humanized light chain
  MISC_FEATURE (159)..(159): can be Valine or Alanine
  MISC_FEATURE (197)..(197): can be Leucine or Valine
DIVMTQSPDSLAVSLGERATINCKSSQSLLNSGNQKNYLTWYQQKPGQPPKLLIYWASTRESGVPDRFSGSGSGTDFTLTISSLQAEDVAVYHCQNDYSYPYTFGQGTKLEIKRTVAAPSVFIFPPSDEQLKSGTASVVCLLNNFYPREAKVQWKVDNXLQSGNSQESVTEQDSKDSTYSLSSTLTLSKADYEKHKXYACEVTHQGLSSPVTKSFNRGEC

SEQ ID NO: 557 - protein, 330 aa, Artificial Sequence
  Human IgG1 constant region consensus sequence
  MISC_FEATURE (97)..(97): can be Lysine or Arginine
  MISC_FEATURE (239)..(239): can be Aspartic Acid or Glutamic Acid
  MISC_FEATURE (241)..(241): can be Leucine or Methionine
  MISC_FEATURE (314)..(314): can be Glycine or Alanine
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKXVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRXEXTKNQVSLTCLVKGFYPSDIAVEWESNGQPENNYKTTPPVLDSDGSFFLYSKLTVDKSRWQQGNVFSCSVMHEXLHNHYTQKSLSLSPGK

SEQ ID NO: 558 - protein, 330 aa, Artificial Sequence
  Human IgG1 G1m3 allotype
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - protein, 330 aa, Artificial Sequence [sequence omitted]

SEQ ID NO: 560 - protein, 330 aa, Artificial Sequence
  Human IgG1, G1m17,1,2 allotype
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 561 - protein, 327 aa, Artificial Sequence
  Human IgG4 wt constant regions
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLSSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 562 - protein, 327 aa, Artificial Sequence
  IgG4 constant regions S228P modification
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 563 - protein, 106 aa, Artificial Sequence
  Kappa light chain constant region Consensus sequence
  MISC_FEATURE (45)..(45): can be V or A
  MISC_FEATURE (83)..(83): can be L or V
TVAAPSVFIFPPSDEQLKSGTASVVCLLNNFYPREAKVQWKVDNXLQSGNSQESVTEQDSKDSTYSLSSTLTLSKADYEKHKXYACEVTHQGLSSPVTKSFNRGEC

SEQ ID NO: 564 - protein, 106 aa, Artificial Sequence
  Kappa light chain constant region IGKC*06 Km1 allotype
TVAAPSVFIFPPSDEQLKSGTASVVCLLNNFYPREAKVQWKVDNVLQSGNSQESVTEQDSKDSTYSLSSTLTLSKADYEKHKLYACEVTHQGLSSPVTKSFNRGEC

SEQ ID NO: 565 - protein, 106 aa, Artificial Sequence
  Kappa light chain constant region IGKC*04 Km1,2 allotype
TVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 566 - protein, 106 aa, Artificial Sequence
  Kappa light chain constant region IGKC*01 Km3 allotype
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 567 - protein, 448 aa, Artificial Sequence
  Full-length humanized heavy chain
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 568 - protein, 448 aa, Artificial Sequence
  Full-length humanized heavy chain
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 569 - protein, 448 aa, Artificial Sequence
  Full-length humanized heavy chain
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 570 - protein, 445 aa, Artificial Sequence
  Full-length humanized heavy chain
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLSSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 571 - protein, 220 aa, Artificial Sequence
  Full-length humanized light chain
DIVMTQSPPTLSLSPGERVTLSCKSSQSLLNSGNQKNYLTWYQQKPGQAPRLLIYWASTRESGIPARFSGSGSGTDFTLTISSLQPEDFAVYHCQNDYSYPYTFGQGTKLEIKRTVAAPSVFIFPPSDEQLKSGTASVVCLLNNFYPREAKVQWKVDNVLQSGNSQESVTEQDSKDSTYSLSSTLTLSKADYEKHKLYACEVTHQGLSSPVTKSFNRGEC

SEQ ID NO: 572 - protein, 220 aa, Artificial Sequence
  Full-length humanized light chain
DIVMTQSPPTLSLSPGERVTLSCKSSQSLLNSGNQKNYLTWYQQKPGQAPRLLIYWASTRESGIPARFSGSGSGTDFTLTISSLQPEDFAVYHCQNDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 573 - protein, 220 aa, Artificial Sequence
  Full-length humanized light chain
DIVMTQSPPTLSLSPGERVTLSCKSSQSLLNSGNQKNYLTWYQQKPGQAPRLLIYWASTRESGIPARFSGSGSGTDFTLTISSLQPEDFAVYHCQNDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 574 - protein, 220 aa, Artificial Sequence
  Full-length humanized light chain
DIVMTQSPDSLAVSLGERATINCKSSQSLLNSGNQKNYLTWYQQKPGQPPKLLIYWASTRESGVPDRFSGSGSGTDFTLTISSLQAEDVAVYHCQNDYSYPYTFGQGTKLEIKRTVAAPSVFIFPPSDEQLKSGTASVVCLLNNFYPREAKVQWKVDNVLQSGNSQESVTEQDSKDSTYSLSSTLTLSKADYEKHKLYACEVTHQGLSSPVTKSFNRGEC

SEQ ID NO: 575 - protein, 220 aa, Artificial Sequence
  Full-length humanized light chain
DIVMTQSPDSLAVSLGERATINCKSSQSLLNSGNQKNYLTWYQQKPGQPPKLLIYWASTRESGVPDRFSGSGSGTDFTLTISSLQAEDVAVYHCQNDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 576 - protein, 220 aa, Artificial Sequence
  Full-length humanized light chain
DIVMTQSPDSLAVSLGERATINCKSSQSLLNSGNQKNYLTWYQQKPGQPPKLLIYWASTRESGVPDRFSGSGSGTDFTLTISSLQAEDVAVYHCQNDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 577 - protein, 463 aa, Artificial Sequence
  Syntheic peptide
MNFGLSLIFLVLVLKGVQCQVQLLQSGTELVRPGVSVKISCKGSGYTFTDYAMYWVKQSHAKSLEWIGVIRTYSGDVTYNQKFKDKATMTVDKSSSIAYMELARLSSEDSAIYYCAKSGTVRGFAYWGQGTLVTVSSASTKGPSVFPLAPSSKSTSGGTAALGCLVKDYFPEPVTVSWNSGALTSGVHTFPAVLQSSGKLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 240 aa, Artificial Sequence
  Synthetic peptide
MESQTQVLMSLLFWVSGTCGDIVMTQSPSSLTVTAGEKVIMSCKSSQSLLNSGNQKNYLTWYQQKPGQPPKLLIYWASTRESGVPDRFTGSGSGTDFTLTISSVQAEDLAVYHCQNDYSYPYTFGGGTKLEIKRSVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 579 - protein, 448 aa, Artificial Sequence
  Full length heavy chain
QVQLLQSGTELVRPGVSVKISCKGSGYTFTDYAMYWVKQSHAKSLEWIGVIRTYSGDVTYNQKFKDKATMTVDKSSSIAYMELARLSSEDSAIYYCAKSGTVRGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 580 - protein, 220 aa, Artificial Sequence
  Full length light chain
DIVMTQSPSSLTVTAGEKVIMSCKSSQSLLNSGNQKNYLTWYQQKPGQPPKLLIYWASTRESGVPDRFTGSGSGTDFTLTISSVQAEDLAVYHCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 581 - protein, 444 aa, Artificial Sequence
  Full-length humanzied heavy chain
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 582 - protein, 444 aa, Artificial Sequence
  Full-length humanized heavy chain
QVQLVQSGAEVKKPGASVKVSCKGSGYTFTDYAMYWVRQAPGQGLEWIGVIRTYSGDVTYNQKFKDRATMTVDKSISTAYMELSRLRSDDTAVYYCAKSGTVRGFAYWGQGTLVTVSSASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 583 - protein, 326 aa, Artificial Sequence
  Human IgG2 constant regions
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 584 - protein, 326 aa, Artificial Sequence
  IgG2 constant regions C127S modification
ASTKGPSVFPLAPSSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 585 - protein, 449 aa, Artificial Sequence
  m6C8 full-length heavy chain
QVTLKESGPGILKPSQTLSLTCSFSGFSLSTSGMGVGWIRQPSGKGLEWLAHIWWDDDKYYNPSLKSQLTISKDTSRNQVFLKITSVDTADAATYYCARTRRYFPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 586 - protein, 214 aa, Artificial Sequence
  m6C8 full-length light chain
DIVMTQSQKFMSTSVGDRVSVTCKASQNVGTNVAWYQQKPGQSPKALIYSASYRYSGVPDRFTGSGSGTDFTLTINNVHSEDLAEYFCQQYNTDPLTFGAGTKLEIKRSVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 587 - protein, 220 aa, Artificial Sequence
  Full-length humanized light chain containing T to S mutation
DIVMTQSPDSLAVSLGERATINCKSSQSLLNSGNQKNYLTWYQQKPGQPPKLLIYWASTRESGVPDRFSGSGSGTDFTLTISSLQAEDVAVYHCQNDYSYPYTFGQGTKLEIKRSVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 588 - protein, 107 aa, Artificial Sequence
  Kappa light chain constant region
  MISC_FEATURE (1)..(107): Consensus sequence
  MISC_FEATURE (46)..(46): can be valine or alanine
  MISC_FEATURE (84)..(84): can be valine or leucine
RTVAAPSVFIFPPSDEQLKSGTASVVCLLNNFYPREAKVQWKVDNXLQSGNSQESVTEQDSKDSTYSLSSTLTLSKADYEKHKXYACEVTHQGLSSPVTKSFNRGEC

SEQ ID NO: 589 - protein, 107 aa, Artificial Sequence
  Kappa light chain constant region IGKC*06 Km1 allotype
RTVAAPSVFIFPPSDEQLKSGTASVVCLLNNFYPREAKVQWKVDNVLQSGNSQESVTEQDSKDSTYSLSSTLTLSKADYEKHKLYACEVTHQGLSSPVTKSFNRGEC

SEQ ID NO: 590 - protein, 107 aa, Artificial Sequence
  Kappa light chain constant region IGKC*04 Km1,2 allotype
RTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 591 - protein, 107 aa, Artificial Sequence [sequence omitted]

SEQ ID NO: 592-600 - skipped (9 entries)

SEQ ID NO: 601 - protein, 98 aa, Artificial Sequence
  Germline sequence: IGHV1-2*02 (DP75)
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 602 - protein, 98 aa, Artificial Sequence
  Germline sequence: IGHGV1-3*01
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAR

SEQ ID NO: 603 - protein, 98 aa, Artificial Sequence
  Germline sequence: IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 604 - protein, 98 aa, Artificial Sequence
  Germline sequence: IGHV1-18*01
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAR

SEQ ID NO: 605 - protein, 98 aa, Artificial Sequence
  Germline sequence: IGHV1-69*01
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAR

SEQ ID NO: 606 - protein, 98 aa, Artificial Sequence
  Germline sequence: IGHV7-4-1*02
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCAR

SEQ ID NO: 607 - protein, 100 aa, Artificial Sequence
  Germline sequence: IGKV4-1*01
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYST

SEQ ID NO: 608 - protein, 95 aa, Artificial Sequence
  Germline sequence: IGKV3-7*02
EIVMTQSPPTLSLSPGERVTLSCRASQSVSSSYLSWYQQKPGQAPRLLIYGASTRATGIPARFSGSGSGTDFTLTISSLQPEDFAVYYCQQDYNL

SEQ ID NO: 609 - skipped

SEQ ID NO: 610 - protein, 22 aa, Artificial Sequence
  VL FR1
DIVMTQSPDSLAAPGERATINC

SEQ ID NO: 611 - protein, 23 aa, Artificial Sequence
  VL FR1
DIVMTQSPDSLAVSLGERATINC

SEQ ID NO: 612 - protein, 23 aa, Artificial Sequence
  VL FR1
DIVMTQSPDSLPVSLGERATINC

SEQ ID NO: 613 - protein, 23 aa, Artificial Sequence
  VL FR1
DIVMTQSPDSLSVSLGERATINC

SEQ ID NO: 614 - skipped

SEQ ID NO: 615 - protein, 23 aa, Artificial Sequence
  VL FR1
DIVMTQSPPTLSLSPGERVTLSC

SEQ ID NO: 616 - protein, 23 aa, Artificial Sequence
  VL FR1
DIVMTQSPSSLTVTAGEKVIMSC

SEQ ID NO: 617 - protein, 23 aa, Artificial Sequence
  VL FR2
DIVMTQSTDSLAVSLGERATINC

SEQ ID NO: 618 - protein, 15 aa, Artificial Sequence
  VL FR2
WYHQKPGQPPKLLIY

SEQ ID NO: 619 - protein, 4 aa, Artificial Sequence
  VL FR3
VLFR

SEQ ID NO: 620 - protein, 32 aa, Artificial Sequence
  VL FR1
GVPDRFTGSGSGTDFTLTISSVQAEDVAVYHC

SEQ ID NO: 621 - skipped

SEQ ID NO: 622 - protein, 15 aa, Artificial Sequence
  VL FR2
WYQQKPGQAPRLLIY

SEQ ID NO: 623 - protein, 15 aa, Artificial Sequence
  VL FR2
WYQQKPGQPPKLLIY

SEQ ID NO: 624 - protein, 15 aa, Artificial Sequence
  VL FR2
WYQQKPGQPPKMLIY

SEQ ID NO: 625 - protein, 15 aa, Artificial Sequence
  VL FR2
WYQQKPGQPPKSLIY

SEQ ID NO: 626 - protein, 32 aa, Artificial Sequence
  VL FR3
GIPARFSGSGSGTDFTLTISSLQPEDFAVYHC

SEQ ID NO: 627 - protein, 32 aa, Artificial Sequence
  VL FR3
GVPDRFTGSGSDTDFTLTISSVQAEDVAVYHC

SEQ ID NO: 628 - protein, 32 aa, Artificial Sequence
  VL FR3
GVPDRFSGSGSGTDFTLTISFVQAEDVAVYYC

SEQ ID NO: 629 - protein, 32 aa, Artificial Sequence
  VL FR3
GVPDRFSGSGSGTDFTLTISSFQAEDVAVYHC

SEQ ID NO: 630 - protein, 32 aa, Artificial Sequence
  VL FR3
GVPDRFSGSGSGTDFTLTISSLQAEDVAVYHC

SEQ ID NO: 631 - protein, 32 aa, Artificial Sequence
  VL FR3
GVPDRFSGSGSGTDFTLTISSLQAEDVAVYYC

SEQ ID NO: 632 - protein, 32 aa, Artificial Sequence
  VL FR3
GVPDRFSGSGSGTDFTLTISSVQAEDVAVYHC

SEQ ID NO: 633 - protein, 32 aa, Artificial Sequence
  VL FR3
GVPDRFSGSGSGTDFTLTISSVQAEDVAVYYC

SEQ ID NO: 634 - protein, 32 aa, Artificial Sequence
  VL FR3
GVPDRFSGSGSGTDFTLTISSVQEEDVAVYHC

SEQ ID NO: 635 - protein, 32 aa, Artificial Sequence
  VL FR3
GVPDRFSGSGSGTNFTLTISSVQAEDVAVYHC

SEQ ID NO: 636 - protein, 32 aa, Artificial Sequence
  VL FR3
GVPDRFTGSGSGTDFTLTISSLQAEDVAVYHC

SEQ ID NO: 637 - protein, 32 aa, Artificial Sequence
  VL FR3
GVPDRFTGSGSGTDFTLTISSVQAEDLAVYHC

SEQ ID NO: 638 - protein, 32 aa, Artificial Sequence; identical to SEQ ID NO: 620
  VL FR3

SEQ ID NO: 639 - protein, 32 aa, Artificial Sequence
  VL FR3
GVPDRFTGSGSGTDFTLTISSVQAEDVAVYYC

SEQ ID NO: 640 - skipped

SEQ ID NO: 641 - protein, 10 aa, Artificial Sequence
  VL FR4
FGGGTKLEIK

SEQ ID NO: 642 - protein, 32 aa, Artificial Sequence
  VL FR3
GVPDRFTGSGSGTDFTLTISSLQAEDVAVYYC

SEQ ID NO: 643 - protein, 10 aa, Artificial Sequence
  VL FR4
FGQGTKLEIK

SEQ ID NO: 644 - protein, 30 aa, Artificial Sequence
  VH FR1
QVQLVQSGAGVKKPGASVKVSCKGSGYTFT

SEQ ID NO: 645 - protein, 30 aa, Artificial Sequence
  VH FR1
QVQLLQSGTELVRPGVSVKISCKGSGYTFT

SEQ ID NO: 646 - protein, 30 aa, Artificial Sequence
  VH FR1
QVQLVQSGAEAKKPGASVKVSCKGSGYTFT

SEQ ID NO: 647 - protein, 30 aa, Artificial Sequence
  VH FR1
QVQLVQSGAEVKKPGASVKASCKGSGYTFT

SEQ ID NO: 648 - protein, 30 aa, Artificial Sequence
  VH FR1
QVQLVQSGAEVKKPGASVKVSCKASGYTFT

SEQ ID NO: 649 - protein, 30 aa, Artificial Sequence
  VH FR1
QVQLVQSGAEVKKPGASVKVSCKGSGYTFT

SEQ ID NO: 650 - protein, 30 aa, Artificial Sequence
  VH FR1
QVQLVQSGTEVKKPGASVKVSCKASGYTFT

SEQ ID NO: 651 - protein, 30 aa, Artificial Sequence
  VH FR1
QVQLVQSGTEVKKPGASVKVSCKGSGYTFT

SEQ ID NO: 652 - protein, 14 aa, Artificial Sequence
  VH FR2
WVKQSHAKSLEWIG

SEQ ID NO: 653 - protein, 14 aa, Artificial Sequence
  VH FR2
WVRQAPGQGLEWIG

SEQ ID NO: 654 - protein, 14 aa, Artificial Sequence
  VH FR2
WVRQAPGQGLEWMG

SEQ ID NO: 655 - protein, 14 aa, Artificial Sequence
  VH FR2
WVRQAPGQGMEWIG

SEQ ID NO: 656 - protein, 14 aa, Artificial Sequence
  VH FR2
WVRQAPGQGMEWMG

SEQ ID NO: 657 - protein, 14 aa, Artificial Sequence
  VH FR2
WVRQAPGQSLEWMG

SEQ ID NO: 658 - protein, 32 aa, Artificial Sequence
  VH FR3
KATMTVDKSSSIAYMELARLSSEDSAIYYCAK

SEQ ID NO: 659 - protein, 32 aa, Artificial Sequence
  VH FR3
RATMTVDKSISTAYMELSRLRSDDTAVYYCAK

SEQ ID NO: 660 - protein, 32 aa, Artificial Sequence
  VH FR3
RATMTVDTSISTAYMELSRLQSDDTAVYYCAK

SEQ ID NO: 661 - protein, 32 aa, Artificial Sequence
  VH FR3
RATMTVDTSISTAYMELSRLRGDDTAVYYCAK

SEQ ID NO: 662 - protein, 32 aa, Artificial Sequence
  VH FR3
RVTMTVDKSISTAYMELSRLRSDDTAVYYCAK

SEQ ID NO: 663 - protein, 32 aa, Artificial Sequence
  VH FR3
RVTMTVDTSISTAYMELSRLRSDDTAVYYCAK

SEQ ID NO: 664 - protein, 11 aa, Artificial Sequence
  VH FR4
WGQGIPVTVSS

SEQ ID NO: 665 - protein, 11 aa, Artificial Sequence
  VH FR4
WGQGTFVTVSS

SEQ ID NO: 666 - protein, 11 aa, Artificial Sequence
  VH FR4
WGQGTFVTVSS

SEQ ID NO: 667 - protein, 11 aa, Artificial Sequence
  VH FR4
WGQGTLITVSS

SEQ ID NO: 668 - protein, 11 aa, Artificial Sequence
  VH FR4
WGQGTLVTVSS

SEQ ID NO: 669 - protein, 11 aa, Artificial Sequence
  VH FR4
WGRGTLVTVSS

SEQ ID NO: 670 - protein, 32 aa, Artificial Sequence
  VH FR3
RATMTVDTSISTAYMELSRLRSDDTAVYYCAK

SEQ ID NO: 671-697 - skipped (27 entries)

SEQ ID NO: 698 - protein, 234 aa, Artificial Sequence
  V1M cynomolgus GITR immature protein
MARHGAMCACGTLCCLALLCAASLGQRPTGGPGCGPGRLLLGTGKDARCCRVHPTRCCRDYQSEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIVLLAVAACVLLLTSAQLGLHIWQLGKTQLLLEVPPSTEDASSCQFPEEERGERLAEEKGRLGDLWV

SEQ ID NO: 699 - protein, 234 aa, Artificial Sequence
  V1M/Q62P/S63G cynomolgus GITR immature protein
MARHGAMCACGTLCCLALLCAASLGQRPTGGPGCGPGRLLLGTGKDARCCRVHPTRCCRDYPGEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIVLLAVAACVLLLTSAQLGLHIWQLGKTQLLLEVPPSTEDASSCQFPEEERGERLAEEKGRLGDLWV

SEQ ID NO: 700 - protein, 216 aa, Homo sapiens
  MISC_FEATURE (1)..(216): human GITR mature protein
QRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 701 - protein, 241 aa, Homo sapiens
  MISC_FEATURE (1)..(241): Human GITR (Isoform 1)
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 702 - protein, 255 aa, Homo sapiens
  MISC_FEATURE (1)..(255): Human GITR (Isoform 2)
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCCWRCRRRPKTPEAASSPRKSGASDRQRRRGGWETCGCEPGRPPGPPTAASPSPGAPQAAGALRSALGRALLPWQQKWVQEGGSDQRPGPCSSAAAAGPCRRERETQSWPPSSLAGPDGVGS

SEQ ID NO: 703 - protein, 234 aa, Homo sapiens
  MISC_FEATURE (1)..(234): Human GITR (Isoform 3)
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRKTQLLLEVPPSTEDARSCQFPEEERGERSAEEKGRLGDLWV

SEQ ID NO: 704 - protein, 234 aa, Artificial Sequence
  cynomolgus GITR immature protein
VARHGAMCACGTLCCLALLCAASLGQRPTGGPGCGPGRLLLGTGKDARCCRVHPTRCCRDYQSEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIVLLAVAACVLLLTSAQLGLHIWQLGKTQLLLEVPPSTEDASSCQFPEEERGERLAEEKGRLGDLWV

SEQ ID NO: 705 - DNA, 23 bp, Artificial Sequence
  Primer 892-Je
gaccaatagaaactgggcttgtc

SEQ ID NO: 706 - DNA, 21 bp, Artificial Sequence
  Primer 327-Je
ctcgatcctccctttatccag

SEQ ID NO: 707 - DNA, 25 bp, Artificial Sequence
  Primer 89-AL
gcctccgcctcctcttcctccatcc

SEQ ID NO: 708 - DNA, 41 bp, Artificial Sequence
  Primer 1192-Je
tctgctcttctaccatggattggacttggcgcattctgttc

SEQ ID NO: 709 - DNA, 35 bp, Artificial Sequence
  Primer 1193-Je
cttgctcttctatggtgttacagactcaggtgttc

SEQ ID NO: 710 - DNA, 29 bp, Artificial Sequence
  Primer 1060-Je
tacgctcttcaagctgctggagggcacgg

SEQ ID NO: 711 - DNA, 28 bp, Artificial Sequence
  Primer 1065-Je
cttgctcttcgctcagcgtcagggtgct

SEQ ID NO: 712 - DNA, 21 bp, Artificial Sequence
  Primer 1152-Je
gagctcctcgaggccaccatg

SEQ ID NO: 713 - DNA, 18 bp, Artificial Sequence
  Primer 1204-Je
cgcggccgcgaattctta

SEQ ID NO: 714 - DNA, 19 bp, Artificial Sequence
  Primer 1155-Je
ccttgaacctcctcgttcg

SEQ ID NO: 715 - protein, 198 aa, Artificial Sequence
  Synthetic Peptide
MTLHPSPITCEFLFSTALISPKMCLSHLENMPLSHSRTQGAQRSSWKLWLFCSIVMLLFLCSFSWLIFILQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 716 - protein, 199 aa, Homo sapiens
  MISC_FEATURE (1)..(199): human GITRL protein sequence
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 717-799 - skipped (83 entries)

SEQ ID NO: 800 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgccatgtattgggtgagacaagcacctggacaaggcttggagtggatcggagttatccgaacctatagtgggggtgttacttacaaccagaagttccagggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 801 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaggcatggagtggatcggacttatccgaacctttagtggggaagtttcttacaaccagaagttccagggaagggttaccatgacggtggacacgagcatctccactgcctacatggaactgagtcggctacgaagcgacgatacagcggtatactactgtgccaaaagcggcactgtacgtggccttgcctattggggtcagggaacactcgtcacagtttcgagc

SEQ ID NO: 802 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgcattgggtgagacaagcacctggacaaggcatggagtggatcggacttatcagaacctatagtgggggtgtttcttacaaccagaagttccggggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 803 - DNA, 412 bp, Artificial Sequence
  Additional VH regions from germlined variants
satggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgttatgcattgggtgagacaagcacctggacaaggcatggagtggatgggagttatccgaacctatagtggggaagtttcttacaaccagaagttccaggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 804 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaagcttggagtggatgggacttatccgaacctttagtggggatgtttcttacaaccagaagttccaggatagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 805 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgcattgggtgagacaagcacctggacaaggcttggagtggatgggacttatcagaacctatagtgggggagttacttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 806 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcttggagtggatgggacttatccgaacctttagtgggggtgtttcttacaaccagaagttcaagggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 807 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggttatgccatgcattgggtgagacaagcacctggacaaggcatggagtggatgggacttatccgaacctttagtgggggactttcttacaaccagaagttccgggaaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 808 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgtcatgtattgggtgagacaagcacctggacaaggcttggagtggatgggagttatcaaaacctttagtgggggtgtttcttacaaccagaagttccaggaaagggttaccatgacggtggacaagagcatctccactgcctacatggaactgagtcggctacgaagcgacgatacagcggtatactactgtgccaaaagcggcactgtacgtggctttgcatattggggtcagggaacactcgtcacagtttcgagc

SEQ ID NO: 809 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggatatgctatgtattgggtgagacaagcacctggacaaggcttggagtggatgggacttatcagaacctatagtggggaagtttcttacaaccagaagttcaggggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 810 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcttggagtggatgggacttatccgaacctatagtgggggagtttcttacaaccagaagttccggggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 811 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgcattgggtgagacaagcacctggacaaggcttggagtggatgggacttatccgaacctatagtgggggtgtttcttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 812 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgccatgtattgggtgagacaagcacctggacaaggcttggagtggatcggagttatccgaacctttagtggggaagtttcttacaaccagaagttcaagggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 813 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggatatgctatgtattgggtgagacaagcacctggacaaggcttggagtggatgggacttatcagaacctttagtggggatgttacttacaaccagaagttccggggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 814 - DNA, 411 bp, Artificial Sequence
  Additional VH regions from germlined variants
atggattggacttggcgcattttgttccttgttgctgccgctactggcgcccattctcaggtgcagttggtccagtctgggactgaggtgaagaaacccggtgcttcggtgaaagtgtcctgcaaaggttcagggtacacctttaccggatatgtcatgcattgggtgagacaagcacctggacaaggcttggagtggatgggacttatcagaacctatagtggggatgtttcttacaaccagaagttccgggatagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 815 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgccatgtattgggtgagacaagcacctggacaaggcttggagtggatcggagttatcagaacctttagtggggatgtttcttacaaccagaagttccgggaaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 816 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccggttatgccatgtattgggtgagacaagcacctggacaaggcttggagtggatcggacttatcagaacctttagtgggggtgttacttacaaccagaagttccgggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 817 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcttggagtggatgggagttatccaaacctttagtgggggtgttacttacaaccagaagttccggggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 818 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccggttatgctatgtattgggtgagacaagcacctggacaaggcatggagtggatcggacttatccgaacctttagtggggaagttacttacaaccagaagttcaggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 819 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgccatgtattgggtgagacaagcacctggacaaggcttggagtggatgggacttatccgaacctatagtgggggactttcttacaaccagaagttccaggatagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 820 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgtattgggtgagacaagcacctggacaaggcatggagtggatcggagttatcagaacctttagtgggggtcttacttacaaccagaagttcaagggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 821 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgccatgtattgggtgagacaagcacctggacaaggcttggagtggatcggagttatccgaacctttagtggggatctttcttacaaccagaagttcaggggaagggttaccatgacggtggacacgagcatctccactgcctacatggaactgagtcggctacgaagcgacgatacagcggtatactactgtgccaaaagcggcactgtacgtggctttgcctattggggtcaggggacactcgtcacagtttcgagc

SEQ ID NO: 822 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgttatgcattgggtgagacaagcacctggacaaggcatggagtggatcggagttatcagaacctttagtggggatgtttcttacaaccagaagttcagggaaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 823 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggttatgccatgtattgggtgagacaagcacctggacaaggcatggagtggatcggagttatccgaacctttagtggggatgttacttacaaccagaagttccggggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 824 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgccatgtattgggtgagacaagcacctggacaaggcatggagtggatcggacttatcagaacctttagtggggatgttacttacaaccagaagttccggggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 825 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagcgtcctgcaaaggttcagggtacacctttaccgattatgctatgcattgggtgagacaagcacctggacaaggcatggagtggatcggacttatccgaacctatagtgggggagttacttacaaccagaagttccggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 826 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaggcttggagtggatgggacttatccgaacctttagtgggggagtttcttacaaccagaagttccggggtagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 827 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgctatgcattgggtgagacaagcacctggacaaggcatggagtggatgggacttatcagaacctttagtggggatgtttcttacaaccagaagttcaagggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 828 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcatggagtggatgggacttatcagaacctatagtgggggtgtttcttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 829 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgctatgtattgggtgagacaagcacctggacaaggcttggagtggatcggagttatcagaacctttagtgggggagttacttacaaccagaagttccggggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 830 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggttaaagtgtcctgcaaaggttcagggtacacctttaccgattatgctatgtattgggtgagacaagcacctggacaaggcttggagtggatcggagttatccgaacctttagtgggggtgttacttacaaccagaagttcaagggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 831 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgttatgtattgggtgagacaagcacctggacaaggcttggagtggatgggagttatcagaacctttagtgggggtctttcttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 832 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgctatgtattgggtgagacaagcacctggacaaggcttggagtggatgggacttatccgaacctttagtgggggtcttacttacaaccagaagttcaaggatagggttaccatgacggtggacaagagcatctccactgcctacatggaactgagtcggctacgaagcgacgatacagcggtatactactgtgccaaaagcggcactgtacgtggctttgcctattggggtcagggaatacccgtcacagtttcgagc

SEQ ID NO: 833 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgctatgtattgggtgagacaagcacctggacaaggcatggagtggatgggagttatccgaacctttagtgggggtgttacttacaaccagaagttcaaggatagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 834 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggatatgccatgtattgggtgagacaagcacctggacaaggcatggagtggatcggacttatcagaacctatagtgggggagttacttacaaccagaagttccagggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 835 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgccatgtattgggtgagacaagcacctggacaaggcatggagtggatcggagttatcagaacctttagtgggggagttacttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 836 - DNA, 411 bp, Artificial Sequence
  Additional VH regions from germlined variants
atggattggacttggcgcattctgttccttgttgctgccgctactggcgcccattctcaggtgcagttggtccagtctggggctgaggcgaagaaacccggtgcttcggtgaaagtgtcctgcaaaggttcagggtacacctttaccggatatgctatgtattgggtgagacaagcacctggacaaggcatggagtggatcggagttatccgaacctttagtggggatgttacttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 837 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcatggagtggatcggagttatccgaacctttagtgggggtgtttcttacaaccagaagttccgggatagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 838 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgccatgtattgggtgagacaagcacctggacaaggcatggagtggatcggacttatcagaacctttagtggggaagttacttacaaccagaagttcaaggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 839 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgccatgtattgggtgagacaagcacctggacaaggcttggagtggatcggagttatcaaaacctatagtgggggagttacttacaaccagaagttccggggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 840 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgccatgcattgggtgagacaagcacctggacaaggcttggagtggatgggacttatcagaacctatagtgggggagtttcttacaaccagaagttccgggaaagggctaccatgacggtggacacgagcatctccactgcctacatggaactgagtcggctacgaagcgacgatacagcggtatactactgtgccaaaagcggcactgtacgtggctttgcctattggggtcagggaacactcatcacagtttcgagc

SEQ ID NO: 841 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaggcttggagtggatcggagttatcagaacctatagtggggatctttcttacaaccagaagttcaggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 842 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgccatgtattgggtgagacaagcacctggacaaggcatggagtggatcggagttatcagaacctttagtgggggtgttacttacaaccagaagttccaggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 843 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgttatgtattgggtgagacaagcacctggacaaggcttggagtggatgggagttatccgaacctttagtgggggtgtttcttacaaccagaagttcaggggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 844 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgccatgtattgggtgagacaagcacctggacaaggcttggagtggatcggagttatcagaacctttagtggggatcttacttacaaccagaagttccaggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 845 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgccatgtattgggtgagacaagcacctggacaaggcatggagtggatgggacttatccgaacctatagtggggaagtttcttacaaccagaagttccgggaaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 846 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcatggagtggatcggacttatcagaacctttagtggggatgtttcttacaaccagaagttcaagggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 847 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgccatgcattgggtgagacaagcacctggacaaggcttggagtggatgggacttatcagaacctatagtggggatgtttcttacaaccagaagttccagggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 848 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgtattgggtgagacaagcacctggacaaggcttggagtggatcggacttatcagaacctatagtgggggtgtttcttacaaccagaagttccagggtagggttaccatgacggtggacacgagcatctccactgcctacatggaactgagtcggctacgaagcgacgatacagcggtatactactgtgccaaaagcggcactgtacgtggctttgcctattggggtcagggaacattcgtcacagtttcgagc

SEQ ID NO: 849 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcttggagtggatgggacttatcagaacctttagtggggatctttcttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 850 - DNA, 411 bp, Artificial Sequence
  Additional VH regions from germlined variants
atggattggacttggcgcattctgttccttgttgctgccgctactggcgcccactctcaggtgcagttggtccagtctggggctgaggtgaagaaacccggtgcttcggtgaaagtgtcctgcaaagcttcagggtacacctttaccgattatgccatgtattgggtgagacaagcacctggacaaggcatggagtggatgggagttatcagaacctatagtgggggagttacttacaaccagaagttccgggatagggttaccatgacggtggacaagagcatctccactgcctacatggaactgagtcggctacgaagcgacgatacagcggtatactactgtgccaaaagcggcactgtacgtggctttgccgattggggtcagggaacactcgtcacagtttcgagc

SEQ ID NO: 851 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgccatgtattgggtgagacaagcacctggacaaggcatggagtggatcggacttatccgaacctatagtgggggagttacttacaaccagaagttcaggggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 852 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgctatgtattgggtgagacaagcacctggacaaggcttggagtggatgggacttatccgaacctatagtgggggtgttacttacaaccagaagttcaaggaaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 853 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgccatgtattgggtgagacaagcacctggacaaggcttggagtggatgggagttatccgaacctatagtggggatgttacttacaaccagaagttcagggaaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 854 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgccatgtattgggtgagacaagcacctggacaaggcatggagtggatgggacttatccgaacctatagtggggaagtttcttacaaccagaagttccagggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 855 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgctatgtattgggtgagacaagcacctggacaaggcttggagtggatcggacttatccgaacctttagtgggggagtttcttacaaccagaagttcaaggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 856 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgccatgtattgggtgagacaagcacctggacaaggcttggagtggatgggagttatccgaacctttagtgggggagttacttacaaccagaagttcaagggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 857 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgcaatgtattgggtgagacaagcacctggacaaggcttggagtggatgggacttatccgaacctatagtgggggtgtttcttacaaccagaagttcagggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 858 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgccatgcattgggtgagacaagcacctggacaaggcatggagtggatgggagttatcagaacctatagtgggggtctttcttacaaccagaagttcaggggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 859 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcttggagtggatcggagttatcagaacctttagtggggaagttacttacaaccagaagttccaggaaagggttaccatgacggtggacgcgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 860 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcatggagtggatgggacttatccgaacctttagtggggatgtttcttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 861 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgcattgggtgagacaagcacctggacaaggcttggagtggatgggacttatccgaacctatagtgggggtgtttcttacaaccagaagttccagggtagggctaccatgacggtggacacgagcatctccactgcctacatggaactgagtcggctacgaagcgacgatacagcggtatactactgtgctaaaagcggcactgtacgtggctttgcctattggggtcagggaacactcgtcacagtttcgagc

SEQ ID NO: 862 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgccatgtattgggtgagacaagcacctggacaaggcttggagtggatcggacttatccgaacctatagtgggggtgttacttacaaccagaagttccagggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 863 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgctatgtattgggtgagacaagcacctggacaaggcttggagtggatgggagttatccgaacctatagtggggatgttacttacaaccagaagttccgggaaagggctaccatgacggtggacacgagcatctccactgcctacatggaactgagtcggctacgaagcgacgatacagcggtatactactgtgccaaaagcggcactgtacgcggctttgcctattggggtcagggaacactcgtcacagtttcgagc

SEQ ID NO: 864 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcatggagtggatgggagttatcaaaacctatagtgggggtgttacttacaaccagaagttcaagggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 865 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcatggagtggatgggagttatcagaacctatagtggggatgtttcttacaaccagaagttcaggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 866 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgccatgtattgggtgagacaagcacctggacaaggcatggagtggatcggacttatcagaacctatagtggggatgttacttacaaccagaagttcaaggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 867 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgcattgggtgagacaagcacctggacaaggcttggagtggatcggacttatcagaacctatagtgggggagtttcttacaaccagaagttccgggaaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 868 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcttggagtggatgggagttatccgaacctatagtgggggtgttacttacaaccagaagttcaagggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 869 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaggcttggagtggatgggacttatcagaacctatagtgggggagtttcttacaaccagaagttccgggatagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 870 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcttggagtggatgggagttatcaaaacctatagtgggggtgtttcttacaaccagaagttccggggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 871 - DNA, 411 bp, Artificial Sequence
  Additional VH regions from germlined variants
atggattggacttggcgcattttgttccttgttgctgccgctactggcgcccattttcaggtgcagttggtccagtctgggggtgaggtgaagaaacccggtgcttcggtgaaagtgtcctgcaaaggttcagggtacacctttaccggatatgccatgcattgggtgagacaagcccctggacaaggcctggagtggattggagttatccgaacctttagtgggggtgttacttacaaccagaagttcccgggaaggggttccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 872 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgctatgcattgggtgagacaagcacctggacaaggcttggagtggatgggacttatcagaacctatagtgggggtgtttcttacaaccagaagttccaggaaagggttaccatgacggtggacaagagcatttccactgcctacatggaactgagtcggctacgaagcgacgatacagcggtatactactgtgccaaaagcggcactgtacgtggctttgcctattggggtcagggaacactcgtcacagtttcgagc

SEQ ID NO: 873 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggttatgttatgtattgggtgagacaagcacctggacaaggcatggagtggatgggagttatccgaacctttagtgggggtgtttcttacaaccagaagttccagggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 874 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcttggagtggatcggagttatcagaacctttagtgggggtgttacttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 875 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcttggagtggatcggagttatcagaacctttagtggggatgttacttacaaccagaagttcaagggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 876 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgctatgtattgggtgagacaagcacctggacaaggcttggagtggatgggagttatcagaacctatagtggggatgttacttacaaccagaagttccggggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 877 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgctatgtattgggtgagacaagcacctggacaaggcatggagtggatcggagttatcagaacctatagtgggggtgttacttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 878 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcttggagtggatcggagttatccgaacctttagtgggggtctttcttacaaccagaagttcagggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 879 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgtattgggtgagacaagcacctggacaaggcttggagtggatgggagttatcaaaacctatagtgggggagttacttacaaccagaagttccggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 880 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgtaaaggttcagggtacacctttaccggatatgctatgtattgggtgagacaagcacctggacaaggcatggagtggatgggacttatcagaacctttagtggggatgtttcttacaaccagaagttcagggatagggttaccatgacggtggacacgagcatctccactgcctacatggaactgagtcggctacgaagcgacgacacagcggtatactactgtgccaaaagcggcactgtacgtggctttgcctattggggtcagggaacactcgtcacagtttcgagc

SEQ ID NO: 881 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgttatgtattgggtgagacaagcacctggacaaggcttggagtggatgggagttatcagaacctatagtggggaagtttcttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 882 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgtattgggtgagacaagcacctggacaaggcttggagtggatgggagttatccaaacctttagtggggatgtttcttacaaccagaagttcaagggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 883 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggatatgctatgtattgggtgagacaagcacctggacaaggcttggagtggatcggacttatccgaacctatagtgggggagttacttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 884 - DNA, 411 bp, Artificial Sequence
  Additional VH regions from germlined variants
atggattggacttggcgcattctgttccttgctgctgccgctactggcgcccattctcaggtgcagttggtccagtctgggactgaggtgaagaaacccggtgcttcggtgaaagtgtcctgcaaaggttcagggtacacctttaccgaatatgtcatgcattgggtgagacaagcacctggacaaggcatggagtggatgggagttatccgaacctttagtgggggtgtttcttacaaccagaagttcagggaaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 885 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggatatgctatgtattgggtgagacaagcacctggacaaggcttggagtggatgggacttatcagaacctatagtggggatgttacttacaaccagaagttcaggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 886 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccggttatgccatgtattgggtgagacaagcacctggacaaggcatggagtggatcggagttatccgaacctatagtggggatgttacttacaaccagaagttcaaggatagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 887 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgctatgtattgggtgagacaagcacctggacaaggcatggagtggatcggacttatccaaacctatagtgggggtctttcttacaaccagaagttccgggaaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 888 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgttatgtattgggtgagacaagcacctggacaaggcatggagtggatgggagttatcagaacctttagtggggatgtttcttacaaccagaagttccgggatagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 889 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggttatgccatgtattgggtgagacaagcacctggacaaggcatggagtggatgggagttatcagaacctttagtgggggtgttacttacaaccagaagttccggggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 890 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgctatgtattgggtgagacaagcacctggacaaggcttggagtggatgggagttatcagaacctatagtggggatgtttcttacaaccagaagttccaggaaagggctaccatgacggtggacacgagcatctccactgcctacatggaactgagtcggctgcgaagcgacgatacagcggtatactactgtgccaaaagcggcactgtacgtggctttgcctattggggccagggaacactcgtcacagtttcgagc

SEQ ID NO: 891 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgtcatgcattgggtgagacaagcacctggacaaggcatggagtggatcggaattatcaaaacctatagtgggggagtttcttacaaccagaagttccagggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 892 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgcattgggtgagacaagcacctggacaaggcatggagtggatcggacttatccgaacctttagtggggatctttcttacaaccagaagttccggggaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 893 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcatggagtggatcggagttatcaaaacctatagtgggggagttacttacaaccagaagttcaaggatagggctaccatgacggtggacacgagcatctccactgcctacatggagctgagtcggctacgaagcgacgatacagcggtatactactgtgccaaaagcggcactgtacgtggctttgcctattggggtcagggaacactcgtcacagtttcgagc

SEQ ID NO: 894 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgttatgcattgggtgagacaagcacctggacaaggcatggagtggatgggacttatcagaacctatagtgggggagttacttacaaccagaagttccagggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 895 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgctatgtattgggtgagacaagcacctggacaaggcatggagtggatcggagttatccgaacctttagtgggggagttacttacaaccagaagttcaagggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 896 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggttatgctatgtattgggtgagacaagcacctggacaaggcatggagtggatcggagttatccgaacctttagtggggatgtttcttacaaccagaagttccgggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 897 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgttatgtattgggtgagacaagcacctggacaaggcatggagtggatcggagttatccaaacctatagtgggggactttcttacaaccagaagttcaggggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 898 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggatatgccatgtattgggtgagacaagcacctggacaaggcttggagtggatcggagttatcagaacctatagtgggggtgttacttacaaccagaagttccagggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 899 - DNA, 411 bp, Artificial Sequence
  Additional VH regions from germlined variants
atggattggacttggcgcattctgttccttgttgctgccgctactggcgcccattctcaggtgcagttggtccagtctggggctggggtgaagaaacccggtgcttcggtgaaagtgtcctgcaaaggttcagggtacacctttaccgattatgccatgcattgggtgagacaagcacctggacaaggcttggagtggatgggacttatccgaacctttagtggggatgtttcttacaaccagaagttccgggaaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 900 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgcattgggtgagacaagcacctggacaaggcttggagtggatcggacttatccaaacctatagtggggatgtttcttacaaccagaagttcaggggtagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 901 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgccatgtattgggtgagacaagcacctggacaaggcttggagtggatcggagttatcaaaacctatagtgggggtgttacttacaaccagaagttccgggatagggctaccatgacggtggacacgagcatctccactgcctacatggaactgagtcggctacgaggcgacgatacagcggtatactactgtgccaaaagcggcactgtacgtggctttgcctattggggtcggggaacactcgtcacagtttcgagc

SEQ ID NO: 902 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgccatgcattgggtgagacaagcacctggacaaggcatggagtggatgggacttatccgaacctatagtgggggtgtttcttacaaccagaagttccgggatagggttaccatgacggtggacaagagtatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 903 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgctatgcattgggtgagacaagcacctggacaaggcatggagtggatcggacttatcagaacctatagtgggggtgtttcttacaaccagaagttcaagggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 904 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgctatgcattgggtgagacaagcacctggacaaggcatggagtggatgggacttatcagaacctatagtgggggagttacttacaaccagaagttccgggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 905 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgctatgcattgggtgagacaagcacctggacaaggcatggagtggatgggacttatcagaacctttagtggggatgtttcttacaaccagaagttccggggtagggttaccatgacggtggacacgagtatctccactgcctacatggaactgagtcggctacgaagcgatgatacagcggtatactactgtgccaaaagcggcactgtacgtggctttgcctattggggtcagggaacactcgtcacagtttcgagc

SEQ ID NO: 906 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcatggagtggatgggagttatccgaacctttagtgggggtgtttcttacaaccagaagttccgggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 907 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgccatgtattgggtgagacaagcacctggacaaggcttggagtggatgggacttatccgaacctttagtggggaagtttcttacaaccagaagttccaggatagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 908 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgtcatgcattgggtgaggcaagcacctggacaaggcatggagtggatgggagttatccgaacctttagtgggggtgtttcttacaaccagaagttccggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 909 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgctatgtattgggtgagacaagcacctggacaaggcatggagtggatgggagttatccgaacctttagtggggatgtttcttacaaccagaagttccgggatagggttaccatgacggtggacacgagcatctccactgcctacatggaactgagtcggttacgaagcgacgatacagcggtatactactgtgccaaaagcggcactgtacgtggctttgcctattggggtcagggaacactcgtcacagtttcgagc

SEQ ID NO: 910 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggttatgctatgtattgggtgagacaagcacctggacaaggcatggagtggatgggacttatcagaacctttagtggggatgttacttacaaccagaagttccggggtagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 911 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgctatgcattgggtgagacaagcacctggacaaggcatggagtggatcggacttatccgaacctatagtggggatgtttcttacaaccagaagttcaggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 912 - DNA, 411 bp, Artificial Sequence
  Additional VH regions from germlined variants
atggattggacttggcgcattctgttccttgttgctgccgctactggtgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcttggagtggatgggagttatcagaacctatagtgggggtgttacttacaaccagaagttcaaggatagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 913 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgtattgggtgagacaagcacctggacaaggcatggagtggatgggagttatcagaacctatagtgggggagttacttacaaccagaagttccgggatagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 914 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgttatgcattgggtgagacaagcacctggacaaggcatggagtggatgggacttatccgaacctatagtgggggagtttcttacaaccagaagttcagggaaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 915 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgccatgtattgggtgagacaagcacctggacaaggcttggagtggatgggagttatcagaacctatagtgggggtctttcttacaaccagaagttcaggggtagggctaccatgacggtggacaagagcatctccactgcctacatggaactgagtcggctacgaagcgacgatacagcggtatactactgtgccaaaagcggcactgtacgtggctttgcccattggggtcagggaacactcgtcacagtttcgagc

SEQ ID NO: 916 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgccatgtattgggtgagacaagcacctggacaaggcatggagtggatcggagttatccgaacctatagtgggggagttacttacaaccagaagttccagggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 917 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgcattgggtgagacaagcacctggacaaggcttggagtggatcggacttatcagaacctatagtgggggagttacttacaaccagaagttccgggaaagggctaccatgacggtggacaagagcatctccactgcctacatggaactgagtcggctacgaagcgacgatacagcggtatactactgtgccaaaagcggcactgtacgtggctttgcctattggggtcagggaacattcgtcacagtttcgagc

SEQ ID NO: 918 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggttatgctatgtattgggtgagacaagcacctggacaaggcatggagtggatcggagttatccgaacctttagtggggatctttcttacaaccagaagttcaagggtagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 919 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcatggagtggatgggagttatcagaacctatagtggggaagtttcttacaaccagaagttccgggatagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 920 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgcattgggtgagacaagcacctggacaaggcatggagtggatcggacttatccgaacctttagtggggatgttacttacaaccagaagttccaggatagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 921 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgcattgggtgagacaagcacctggacaaggcttggagtggatgggagttatccgaacctatagtggggatgtttcttacaaccagaagttcaggggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 922 - DNA, 411 bp, Artificial Sequence
  Additional VH regions from germlined variants
atggattggacttggcgcattctgttccttgttgctgccgctactggcgcctattctcaggtgcagttggtccagtctgggactgaggtgaagaaacccggtgcttcggtggaagtgtcctgcaaaggttcagggtacacctttaccgattatgccatgcattgggtgagacaagcacctggacaaggcttggagtggatcggacttatcagaacctttagtggggatgtttcttacaaccagaagttcaggggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 923 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccggttatgccatgtattgggtgagacaagcacctggacaaggcatggagtggatgggagttatccgaacctttagtggggatgttacttacaaccagaagttcaggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 924 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcttggagtggatcggacttatccgaacctatagtggggatctttcttacaaccagaagttcaaggaaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 925 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgctatgcattgggtgagacaagcacctggacaaggcatggagtggatgggacttatcagaacctatagtgggggagtttcttacaaccagaagttccaggaaagggctaccatgacggtggacacgagcatttccactgcctacatggaactgagtcggctacgaagcgacgatacagcggtatactactgtgccaaaagcggcactgtacgtggctttgcttattggggtcagggaacactcgtcacagtttcgagc

SEQ ID NO: 926 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggttatgccatgtattgggtgagacaagcacctggacaaggcttggagtggatcggacttatcagaacctatagtggggaagtttcttacaaccagaagttccagggtagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 927 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcttggagtggatgggacttatccgaacctttagtgggggtgttacttacaaccagaagttccagggtagggctaccatgacggtggacacgagcatctccactgcctacatggaactgagtcggctacaaagcgacgatacagcggtatactactgtgccaaaagcggcactgtacgtggctttgcctattggggtcagggaacactcgtcacagtttcgagc

SEQ ID NO: 928 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgccatgcattgggtgagacaagcacctggacaaggcatggagtggatgggagttatccaaacctatagtggggatgtttcttacaaccagaagttccagggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 929 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgcattgggtgagacaagcacctggacaaggcatggagtggatgggacttatccgaacctatagtggggatctttcttacaaccagaagttcaggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 930 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgcattgggtgagacaagcacctggacaaggcttggagtggatgggagttatccgaacctatagtgggggtgtttcttacaaccagaagttccaggaaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 931 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgccatgtattgggtgagacaagcacctggacaaggcttggagtggatgggacttatcaaaacctatagtggggatgtttcttacaaccagaagttcagggaaagggttaccatgacggtggacaagaacatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 932 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgccatgtattgggtgagacaagcacctggacaaggcatggagtggatgggacttatcagaacctatagtgggggtgtttcttacaaccagaagttcaagggaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 933 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggttatgctatgtattgggtgagacaagcacctggacaaggcttggagtggattggagttatcagaacctatagtggggatgtttcttacaaccagaagttccaggatagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 934 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgctatgtattgggtgagacaagcacctggacaaggcttggagtggatgggagttatccgaacctttagtgggggacttacttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 935 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccggatatgccatgtattgggtgagacaagcacctggacaaggcttggagtggatcggagttatccgaacctttagtgggggtgttacttacaaccagaagttccgggatagggttaccatgacggtggacaagagcatctccactgcctacatggaactgagtcggctacgaagcgacgatacagcggtatactactgtgccaaaagcggcactgtacgtggctttgcctattggggtcagggaacattcgtcacagtttcgagc

SEQ ID NO: 936 - DNA, 411 bp, Artificial Sequence
  Additional VH regions from germlined variants
atggattggacttggcgcattctgttccttgttgctgccgctactggcgcccattctcaggtgcggttggtccagtctgggactgaggtgaagaaacccggtgcttcggtgaaagtgtcctgcaaaggttcagggtacacctttaccggatatgctatgtattgggtgagacaagcacctggacaaggcatggagtggatgggagttatcagaacctttagtggggatgttacttacaaccagaagttcaaggaaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 937 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacctggtgcttcggtgaaagtgtcctgcaaaggttcagggtacacctttaccggttatgccatgcattgggtgagacaagcacctggacaaggcttggagtggatgggacttatccgaacctatagtgggggagtttcttacaaccagaagttcagggaaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 938 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcatggagtggatcggacttatcagaacctttggtggggatgttacttacaaccagaagttcaggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 939 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcttggagtggatgggacttatcagaacctatagtgggggtgtttcttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacattcgtcacagtttcgagc

SEQ ID NO: 940 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcatggagtggatgggagttatccgaacctatagtgggggtcttacttacaaccagaagttccgggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 941 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgccatgcattgggtgagacaagcacctggacaaggcatggagtggatcggacttatcagaacctttagtgggggtctttcttacaaccagaagttccgggatagggttaccatgacggtggacaagagcatctccactgcctacatggaactgagtcggctacgaagcgacgatacagcggtatactactgtgccaaaagcggcactgtacgtggctttgcctattggggtcaaggaacactcgtcacagtttcgagc

SEQ ID NO: 942 - DNA, 411 bp, Artificial Sequence
  Additional VH regions from germlined variants
atggattggacttggcgcattctgttccttgttgctgccgctaccggcgcccattctcaggtgcagttggtccagtctggggctgaggtgaagaaacccggtgcttcggtgaaagtgtcctgcaaaggttcagggtacacctttaccggttatgctatgcattgggtgagacaagcacctggacaaggcatggagtggatgggacttatccgaacctttagtgggggtctttcttacaaccagaagttccgggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 943 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccggatatgctatgcattgggtgagacaagcacctggacaaggcatggagtggatgggagttatcagaacctttagtgggggagtttcttacaaccagaagttccaggaaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 944 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgccatgcattgggtgagacaagcacctggacaaggcatggagtggatgggacttatccgaacctttagtggggatctttcttacaaccagaagttcaggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 945 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgctatgcattgggtgagacaagcacctggacaaggcatggagtggatgggagttatccgaacctttagtgggggagtttcttacaaccagaagttccagggtagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 946 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcatggagtggatcggacttatccgaacctatagtgggggagtttcttacaaccagaagttccggggtagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 947 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgctatgcattgggtgagacaagcacctggacaaggcttggagtggatgggacttatcagaacctttagtgggggagtttcttacaaccagaagttccaggatagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 948 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccggatatgccatgtattgggtgagacaagcacctggacaaggcttggagtggatcggagttatcagaacctatagtgggggagtttcttacaaccagaagttcagggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 949 - DNA, 411 bp, Artificial Sequence
  Additional VH regions from germlined variants
atggattggacttggcgcattctgttccttgttgctgccgttactggcgcccattctcaggtgcagttggtccagtctggggctgaggtgaagaaacccggtgcttcggtgaaagtgtcctgcaaagcttcagggtacacctttaccggatatgctatgtattgggtgagacaagcacctggacaaggcatggagtggatgggagttatccgaacctatagtggggatgtttcttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 950 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcatggagtggatgggacttatcagaacctttagtgggggagtttcttacaaccagaagttccgggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 951 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgccatgtattgggtgagacaagcacctggacaaggcttggagtggatgggacttatccgaacctttagtgggggagtttcttacaaccagaagttcaagggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 952 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgccatgtattgggtgagacaagcacctggacaaggcttggagtggatcggagttatcagaacctttagtggggatgtttcttacaaccagaagttccaggaaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 953 - DNA, 411 bp, Artificial Sequence
  Additional VH regions from germlined variants
atggattggacttggcgcattctgttccttgttgctgccgctactggcacccattctcaggtgcagttggtccagtctggggctgaggtgaagaaacccggtgcttcggtgaaagtgtcctgcaaaggttcagggtacacctttaccggttatgctatgtattgggtgagacaagcacctggacaaggcttggagtggatgggagttatcagaacctatagtggggatgtttcttacaaccagaagttccgggatagggttaccatgacggtggacacgagcatctccactgcctacatggaactgagtcggctacgaagcgacgatacagcggtatactactgtgctaaaagcggcactgtacgtggctttgcctattggggtcagggaacactcgtcacagtttcgagc

SEQ ID NO: 954 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcatggagtggatgggacttatcagaacctatagtggggaagttacttacaaccagaagttcagggaaagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 955 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgctatgtattgggtgagacaagcacctggacaaggcttggagtggatcggagttatcagaacctttagtgggggagttacttacaaccagaagttccggggtagggctaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 956 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccggatatgccatgtattgggtgagacaagcacctggacaaggcttggagtggatgggacttatcagaacctatagtggggaagtttcttacaaccagaagttccaggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 957 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaggcttggagtggatgggacttatcagaacctttagtgggggtgtttcttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 958 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgccatgtattgggtgagacaagcacctggacaaggcttggagtggatgggagttatccgaacctttagtgggggtgtttcttacaaccagaagttccggggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 959 - DNA, 411 bp, Artificial Sequence
  Additional VH regions from germlined variants
atggattggacttggcgcattctgttccttgttgctgccgctactggtgcccattctcaggtgcagttggtccagtctgggactgaggtgaagaaacccggtgcttcggtgaaagtgtcctgcaaagcttcagggtacacctttaccgattatgctatgtattgggtgagacaagcacctggacaaggcatggagtggatgggagttatcaaaacctttagtgggggtgttacttacaaccagaagttccgggggagggttaccatgacagtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 960 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccggatatgccatgtattgggtgagacaagcacctggacaaggcatggagtggatgggagttatcagaacctttagtggggatgttacttacaaccagaagttccgggaaagggctaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 961 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgaatatgccatgtattgggtgagacaagcacctggacaaggcttggagtggatcggagttatccgaacctttagtggggatgtttcttacaaccagaagttcaagggaagggctaccatgacggtggacacgagcatctccactgcctacatggaactgagtcggctacgaagcgacgatacagcggtatactactgtgccaaaagcggcactgtacgtggctttgcatattggggtcagggaacactcgtcacagtttcgagc

SEQ ID NO: 962 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgctatgtattgggtgagacaagcacctggacaaggcttggagtggatgggacttatcagaacctatagtggggatgtttcttacaaccagaagttccaggatagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 963 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcttggagtggatgggagttatcaaaacctttagtgggggagtttcttacaaccagaagttccggggtagggttaccatgacggtggacacgagcatctccactgcctacatggaactgagtcggctacgaagcgacgatacagcggtatactactgtgccaaaagcggcactgtacgtggctttgcccattggggtcagggaacactcgtcacagtttcgagc

SEQ ID NO: 964 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgattatgctatgtattgggtgagacaagcacctggacaaggcttggagtggatgggacttatcagaacctatagtggggatgtttcttacaaccagaagttccggggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 965 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaaggttcagggtacacctttaccgaatatgctatgtattgggtgagacaagcacctggacaaggcttggagtggatcggagttatccgaacctatagtggggaagtttcttacaaccagaagttccggggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 966 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcttggagtggatcggagttatccaaacctttagtgggggtcttacttacaaccagaagttccaggatagggttaccatgacggtggacaagagcatctccactgcctacatggaactaagtcggctacgaagcgacgatacagcggtatactactgtgccaaaagcggcactgtacgtggctttgcctattggggtcagggaacactcgtcacagtttcgagc

SEQ ID NO: 967 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaggcttggagtggatcggagttatcaaaacctttagtgggggtgtttcttacaaccagaagttccagggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 968 - DNA, 411 bp, Artificial Sequence
  Additional VH regions from germlined variants
atggattggacttggcgcattctgttccttgttgctgccgctactggcgcccattctcaggtgcagttggtccagtctgggactgaggtgaagaaacccggtgcttcggtgaaagtgtcctgcaaagcttcagggtacacctttaccgattatgctatgtattgggtgagacaagcacctggacaaggcttggagtggatgggacttatccgaacctttagtggggatgttacttacaaccagaagttccggggaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 969 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcttggagtggatcggacttatccgaacctatagtggggatgtttcttacaaccagaagttcagggatagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 970 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgctatgtattgggtgagacaagcacctggacaaggcttggagtggatgggagttatcagaacctttagtgggggtgtttcttacaaccagaagttccggggtagggttatcatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 971 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgattatgctatgtattgggtgagacaagcacctggacaaggcttggagtggatcggagttatccgaacctatagtggggatgttacttacaaccagaagttccaggaaagggttaccatgacggtggacaagagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 972 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgattatgctatgtattgggtgagacaagcacctggacaaggcttggagtggatcggagttatcagaacctatagtggggaagtttcttacaaccagaagttccagggtagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 973 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaagcttcagggtacacctttaccgaatatgccatgtattgggtgagacaagcacctggacaaggcatggagtggatgggagttatccgaacctatagtgggaatgtttcttacaaccagaagttcaagggaagggttaccatgacggtggacacgagcatctccactgcctacatggaactgagtcggctacgaagcgacgatacagcggtatactactgtgccaaaagcggcactgtacgtggctttgcctattggggtcagggaacactcgtcacagtttcgagc

SEQ ID NO: 974 - DNA, 411 bp, Artificial Sequence
  Additional VH regions from germlined variants
atggattggacttggcgcattctgttccttgttgctgccgctactggcgcccattctcaggtgcagttggtccagtctggggctgaggtgaagaaacccggtgcttcggtgaaagtgtcctgcaaaggttcagggtacacctttaccgaatatgctatgtattgggtgagacaagcacctggacaaggcttggagtggatgggagttatcagaacctatagtggggatgtttcttacaaccagaagttccaggatagggttaccatgacggtggacacgagcatctccactgcctacatggaactgagtcggctacgaagcgacgatacagcggtatactactgtgccaaaagcggcactgtacgtggctttgcctattggggtcggggaacactcgtcacagtttcgagc

SEQ ID NO: 975-999 - skipped (25 entries)

SEQ ID NO: 1000 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1001 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgaatactcatttccctatacctttgggcaagggaccaagttggagattaag

SEQ ID NO: 1002 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1003 - DNA, 399 bp, Artificial Sequence
  Additional VK regions from germlined variants
atggtgttacagactcaggtgttcatctcccttctgctctggattagtggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatatccctatacctttgggcaagggaccaagttggagattaag

SEQ ID NO: 1004 - DNA, 396 bp, Artificial Sequence
  Additional VK regions from germlined variants
atggtgttacagactcaggtgttcatctcccttctgctctggattagcggtgcctatggcgacatagtgatgactcagagccctgattcgttggctgctcctggcgaaagagcgaccatcaactgcaagtcctctcaaagcctgctgaatagtagtaatcagaagaactacctcacttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgaatactcatttccctatacctttgggcaagggaccaagttggagattaag

SEQ ID NO: 1005 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaaatgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1006 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttcccttcaggcagaggatgttgccgtctaccattgtcagaacgaatactcatttccctatacctttgggcaagggaccaagttggagattaag

SEQ ID NO: 1007 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcctctacacgggaatcaggtgtaccggataggttctctggaagtggatctggcacagactttacgctgacaatcagttccgttcaggcagaggatgttgccgtctaccattgtcagaacgaatactcatatccctatacctttgggcaagggaccaagttggagattaag

SEQ ID NO: 1008 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaaatgctcatctactgggcttctacacgggaatcaggtgtaccggataggttctctggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1009 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1010 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttctctggaagtggatctggcacagactttacgctgacgatcagttccgttcaggcagaggatgttgccgtctaccattgtcagaacgattactcatttccctatacctttgggcaagggaccaagttggagattaag

SEQ ID NO: 1011 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1012 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctactattgtcagaacgattactcatatccctatacctttgggcaagggaccaagttggagattaag

SEQ ID NO: 1013 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1014 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctactattgtcagaacgattactcatatccctatacctttgggcaagggaccaagttggagattaag

SEQ ID NO: 1015 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1016 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1017 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttccgttcaggcagaggatgtcgccgtctaccattgtcagaacgattactcatttccctatacctttgggcaagggaccaagttggagattaag

SEQ ID NO: 1018 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgaatactcatttccctatacctttgggcaagggaccaagttggagattaag

SEQ ID NO: 1019 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcatcagaaaccaggacaacctcccaaaatgctcatctactgggcttctacacgggaatcaggtgtaccggataggttcactggaagtggatctggcacagactttacgctgacaatcagttccgttcaggcagaggatgttgccgtctactattgtcagaacgattactcatatccctatacctttgggcaagggaccaagttggagattaag

SEQ ID NO: 1020 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1021 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaaatgctcctctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1022 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1023 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1024 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgatcactcatttccctatacctttgggcaagggaccaagttggagattaag

SEQ ID NO: 1025 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgattactcatctccctatacctttgggcaagggaccaagttggagattaag

SEQ ID NO: 1026 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1027 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaaatgctcatctactgggcttctacacgggaatcaggtgtaccggataggttcactggaagtggatctggcacagactttacgctgacaatcagttccgttcaggcagaggatgttgccgtctactattgtcagaacgattactcatttccctatacctttgggcaagggaccaagttggagattaag

SEQ ID NO: 1028 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaaatgctcatctactgggcttctacacgggaatcaggtgtaccggataggttctctggaagtggatctggcacagactttacgctgacaatcagttccgttcaggcagaggatgttgccgtctactattgtcagaacgaatactcatttccctatacctttgggcaagggaccaagttggagattaag

SEQ ID NO: 1029 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1030 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1031 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1032 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttcccttcaggcagaggatgttgccgtctactattgtcagaacgattactcatatccctatacctttgggcaagggaccaagttggagattaag

SEQ ID NO: 1033 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1034 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1035 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgaatactcatatccctatacctttgggcaagggaccaagttggagattaag

SEQ ID NO: 1036 - DNA, 399 bp, Artificial Sequence
  Additional VK regions from germlined variants
atggtgttacagactcaggtgttcatctcccttctgctctggattagcggtgcctatggcgacatagtgatgactcagagcactgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1037 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatatccctatacctttgggcaagggaccaagttggagattaag

SEQ ID NO: 1038 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcatcagaaaccaggacaacctcccaaaatgctcatctactgggcttctacacgggaatcaggtgtaccggataggttctctggaagtggatctggcacagactttacgctgacaatcagttccgttcaggaagaggatgttgccgtctaccattgtcagaacgattactcatttccctatacctttgggcaagggaccaagttggagattaag

SEQ ID NO: 1039 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgaatactcatatccctatacctttgggcaagggaccaagttggagattaag

SEQ ID NO: 1040 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttctctggaagtggatctggcacagactttacgctgacaatcagttcccttcaggcagaggatgttgccgtctactattgtcagaacgattactcatatccctatacctttgggcaagggaccaagttggagattaag

SEQ ID NO: 1041 - DNA, 399 bp, Artificial Sequence
  Additional VK regions from germlined variants
atggtgttacagactcaggtgttcatctcccttctgctctggattagtggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgaatactcatttccctatacctttgggcaagggaccaagttggagattaag

SEQ ID NO: 1042 - DNA, 399 bp, Artificial Sequence
  Additional VK regions from germlined variants
atggtgttacagactcaggtgttcatctcccttctgctctggattagcggtgtctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttctgttcaggcagaggatgttgccgtctaccattgtcagaacgaatactcatatccctatacctttgggcaagggaccaagttggagattaag

SEQ ID NO: 1043 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1044 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttcccttcaggcagaggatgttgccgtctactattgtcagaacgattactcatatccctatacctttgggcaagggaccaagttggagattaag

SEQ ID NO: 1045 - DNA, 399 bp, Artificial Sequence
  Additional VK regions from germlined variants
atggtgttacagactcaggtgttcatctcccttctgctctggattagcggtgcctatggcgatatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaaatgctcatctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1046 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaaatgctcatctactgggcttctacacgggaatcaggtgtaccggataggttcactggaagtggatctggcacagactttacgctgacaatcagttccgttcaggcagaggatgttgccgtctactattgtcagaacgaatactcatttccctatacctttgggcaagggaccaagttggagattaag

SEQ ID NO: 1047 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatttccctatacctttgggcaagggaccaagttggagattaag

SEQ ID NO: 1048 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1049 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1050 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1051 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgaatactcatttccctatacctttgggcaagggaccaagttggagattaag

SEQ ID NO: 1052 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1053 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctactattgtcagaacgattactcatatccctatacctttgggcaagggaccaagttggagattaag

SEQ ID NO: 1054 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaaatgctcatctactgggcttctacacgggaatcaggtgtaccggataggttctctggaagtggatctggcacagactttacgctgacaatcagttcccttcaggcagaggatgttgccgtctactattgtcagaacgattactcatatccctatacctttgggcaagggaccaagttggagattaag

SEQ ID NO: 1055 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatctccctatacctttgggcaagggaccaagttggagattaag

SEQ ID NO: 1056 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1057 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1058 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1059 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1060 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1061 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1062 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttctctggaagtggatctggcacagactttacgctgacgatcagttccgttcaggcagaggatgttgccgtctaccattgtcagaacgattactcatatccctatacctttgggcaagggaccaagttggagattaag

SEQ ID NO: 1063 - DNA, 399 bp, Artificial Sequence
  Additional VK regions from germlined variants
atggtgttacagactcaggtgttcatctcccttctgctctggattagtggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1064 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgaatactcatatccctatacctttgggcaagggaccaagttggagattaag

SEQ ID NO: 1065 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatatccctatacctttgggcaagggaccaagttggagattaag

SEQ ID NO: 1066 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1067 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgattactcatttccctatacctttgggcaagggaccaagttggagattaag

SEQ ID NO: 1068 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgaatactcatttccctatacctttgggcaagggaccaagttggagattaag

SEQ ID NO: 1069 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaaatgctcatctactgggcttctacacgggaatcaggtgtaccggataggttcactggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1070 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgaatactcatatccctatacctttgggcaagggaccaagttggagattaag

SEQ ID NO: 1071 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttgcctgtctctcttggcgaaagagcgaccatcaactgcaagtcctctcaaagcctgctgaatagtagtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagtttcgttcaggcagaggatgttgccgtctactattgtcagaacgaatactcatttccctatacctttgggcaagggaccaagttggagattaag

SEQ ID NO: 1072 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1073 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatttccctatacctttgggcaagggaccaagttggagattaag

SEQ ID NO: 1074 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaaatgctcatctactgggcttctacacgggaatcaggtgtaccggataggttcactggaagtggatctggcacagactttacgctgacaatcagttcccttcaggcagaggatgttgccgtctactattgtcagaacgattactcatatccctatacctttgggcaagggaccaagttggagattaag

SEQ ID NO: 1075 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctactattgtcagaacgattactcatttccctatacctttgggcaagggaccaagttggagattaag

SEQ ID NO: 1076 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggacaggttctctggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1077 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1078 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccacattgctcatctactgggcttctacacgggaatcaggtgtaccggataggttcactggaagtggatctggcacagactttacgctgacaatcagttcccttcaggcagaggatgttgccgtctactattgtcagaacgattactcatatccctatacctttgggcaagggaccaagttggagattaag

SEQ ID NO: 1079 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgaatactcatttccctatacctttgggcaagggaccaagttggagattaag

SEQ ID NO: 1080 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtccctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgaatactcatatccctatacctttgggcaagggaccaagttggagattaag

SEQ ID NO: 1081 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgaatactcatttccctatacctttgggcaagggaccaagttggagattaag

SEQ ID NO: 1082 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1083 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1084 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttcccttcaggcagaggatgttgccgtctactattgtcagaacgattactcatatccctatacctttgggcaagggaccaagttggagattaag

SEQ ID NO: 1085 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1086 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatttccctatacctttgggcaagggaccaagttggagattaag

SEQ ID NO: 1087 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttctgttcaggcagaggatgttgccgtctactattgtcagaacgattactcatttccctatacctttgggcaagggaccaagttggagattaag

SEQ ID NO: 1088 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacctggtatcatcagaaaccaggacaacctcccaaaatgctcatctactgggcctctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1089 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaaatgctcatctactgggcttctacacgggaatcaggtgtaccggataggttctctggaagtggatctggcacagactttacgctgacaatcagttcccttcaggcagaggatgttgccgtctactattgtcagaacgattactcatatccctatacctttgggcaagggaccaagttggagattaag

SEQ ID NO: 1090 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctactattgtcagaacgattactcatttccctatacctttgggcaagggaccaagttggagattaag

SEQ ID NO: 1091 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttgtctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1092 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttcccttcaggcagaggatgttgccgtctactattgtcagaacgattactcatatccctatacctttgggcaagggaccaagttggagattaag

SEQ ID NO: 1093 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggtgaaagagcgaccatcaactgcaagtcctctcaaagcctgctgaatagtagtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgattactcatttccctatacctttgggcaagggaccaagttggagattaag

SEQ ID NO: 1094 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1095 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgattactcatatccctatacctttgggcaagggaccaagttggagattaag

SEQ ID NO: 1096 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacagcctcccaaattgctcatctactgggcttctacacgggaatcaggtgtaccggataggttctctggaagtggatctggcacagactttacgctgacaatcagttccgttcaggcagaggatgttgccgtctactattgtcagaacgattactcatatccctatacctttgggcaagggaccaagttggagattaag

SEQ ID NO: 1097 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaagccaggacaacctcccaaattgctcatctactgggcttctacacgggaatcaggtgtaccggataggttctccggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1098 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgattactcatttccctatacctttgggcaagggaccaagttggagattaag

SEQ ID NO: 1099 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgattactcatttccctatacctttgggcaagggaccaagttggagattaag

SEQ ID NO: 1100 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttcccttcaggcagaggatgttgccgtctaccattgtcagaacgaatactcatctccctatacctttgggcaagggaccaagttggagattaag

SEQ ID NO: 1101 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgaatactcatttccctatacctttgggcaagggaccaagttggagattaag

SEQ ID NO: 1102 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaaatgctcatctactgggcttctacacgggaatcaggtgtaccggataggttctctggaagtggatctggcacaaactttacgctgacaatcagttccgttcaggcagaggatgttgccgtctaccattgtcagaacgattactcatatccctatacctttgggcaagggaccaagttggagattaag

SEQ ID NO: 1103 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcatcagaaaccaggacaacctcccaaaatgctcatctactgggcttctacacgggaatcaggtgtaccggataggttcactggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1104 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1105 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcaacagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1106 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatatccctatacctttgggcaagggaccaagttggagattaag

SEQ ID NO: 1107 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctcacttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgaatactcatttccctatacctttgggcaagggaccaagttggagattaag

SEQ ID NO: 1108 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1109 - DNA, 399 bp, Artificial Sequence
  Additional VK regions from germlined variants
atggtgttacagactcaggtgttcatctcccttctgctctggattagcggtgcctatggcgacatagtgatgactcagagccctgactcgttggctgtctctcttggcgaaagagcgaccatcaactgcaagtcctctcaaagcctgctgaatagtggtaatcagaagaactacctcacttggtatcaacagaaaccaggacaacctcccaaaatgctcatctactgggcttctacacgggaatcaggtgtaccggataggttctctggaagtggatctggcacagactttacgctgacaatcagttccgttcaggcagaggatgttgccgtctactattgtcagaacgattactcatttccctatacctttgggcaagggaccaagttggagattaag

SEQ ID NO: 1110 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaaatgctcatctactgggcttctacacgggaatcaggtgtaccggataggttctctggaagtggatctggcacagactttacgctgacaatcagttccgttcaggcagaggatgttgccgtctaccattgtcagaacgattactcatctccctatacctttgggcaagggaccaagttggagattaag

SEQ ID NO: 1111 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcatcagaaaccaggacaacctcccaaattgctcatctactgggcttctacacgggaatcaggtgtaccggataggttctctggaagtggatctggcacagactttacgctgacaatcagttccgttcaggcagaggatgttgccgtctaccattgtcagaacgattactcatttccctatacctttgggcaagggaccaagttggagattaag

SEQ ID NO: 1112 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatatccctatacctttgggcaagggaccaagttggagattaag

SEQ ID NO: 1113 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttcccttcaggcagaggatgttgccgtctaccattgtcagaacgattactcatctccctatacctttgggcaagggaccaagttggagattaag

SEQ ID NO: 1114 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttcccttcaggcagaggatgttgccgtctactattgtcagaacgaatactcatttccctatacctttgggcaagggaccaagttggagattaag

SEQ ID NO: 1115 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttctctggaagtggatctggcacagactttacgctgacaatcagttcctttcaggcagaggatgttgccgtctaccattgtcagaacgaatactcatatccctatacctttgggcaagggaccaagttggagattaag

SEQ ID NO: 1116 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcaacagaaaccaggacaacctcccaaattgctcatctactgggcttctacacgggaatcaggtgtaccggataggttctctggaagtggatctggcacagactttacgctgacaatcagttccgttcaggcagaggatgttgccgtctactattgtcagaacgattactcatatccctatacctttgggcaagggaccaagttggagattaag

SEQ ID NO: 1117 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtagtaatcagaagaactacctcacttggtatcaacagaaaccaggacaacctcccaaatcgctcatctactgggcttctacacgggaatcaggtgtaccggataggttctctggaagtggatctggcacagactttacgctgacaatcagttccgttcaggcagaggatgttgccgtctaccattgtcagaacgattactcatatccctatacctttgggcaagggaccaagttggagattaag

SEQ ID NO: 1118 - DNA, 399 bp, Artificial Sequence
  Additional VK regions from germlined variants
atggtgttacagactcaggtgttcatctcccttctgctctggattagcggtgcctatggcgacatagtgatgactcagagccctgattcgttggctgtctctcttggcgaaagagcgaccatcaactgcaagtcctctcaaagcctgctgaatagtggtaatcagaagaactacctctcttggtatcatcagaaaccaggacaacctcccaaattgctcatctactgggcttctacacgggaatcaggtgtaccggataggttcactggaagtggatctggcacagactttacgctgacaatcagttccgttcaggcagaggatgttgccgtctactattgtcagaacgattactcatatccctatacctttgggcaagggaccaagttggagattaag

What is claimed:

1. An isolated antibody that specifically binds to human GITR, wherein the human GITR comprises amino acid residues 26-241 of SEQ ID NO: 701, wherein the antibody binds to at least one amino acid residue selected from the group consisting of amino acid residues 62 and 63 of SEQ ID NO: 701, and wherein the antibody is not a polyclonal antibody.

2. A pharmaceutical composition comprising the antibody of claim 1 and a pharmaceutically acceptable carrier or excipient.

3. The antibody of claim 1, wherein the binding between the antibody and a variant GITR is substantially weakened relative to the binding between the antibody and the human GITR, and wherein the variant GITR comprises residues 26-241 of SEQ ID NO: 701, except for the amino acid substitution G63A.

4. A pharmaceutical composition comprising the antibody of claim 3 and a pharmaceutically acceptable carrier or excipient.

* * * * *